United States Patent 11,708,396 (SIGNAL-SENSOR POLYNUCLEOTIDES FOR THE ALTERATION OF CELLULAR PHENOTYPES) - sequence listing, part 2

SEQ ID NO: 999 - DNA, 1545 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 1000 - DNA, 1359 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 1001 - DNA, 1785 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 1002 - DNA, 1959 bp, Homo sapiens
ggagagtgtgcggctccaggtgggctcacgcgatactggatttcaccatggtgcccaggctggtcttgaattcctgggctcaagcaatctacctgcgttggcctcccaaagtgctgggattacagacatgaaccaccacacctggcagaacctttgtatcttgaaagctgtgtaaatacaatcagtgtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatta

SEQ ID NO: 1003 - DNA, 2560 bp, Homo sapiens
cttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagagaaaatacttaaaatctactctctcagctgattttcaaaaatacggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1004 - DNA, 4769 bp, Homo sapiens
agcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcagaagatcccagagaaggactctgactggctcacctggagtggagctcctatccctggattcttcaggctttcatttgacccacatggttaagctgggagagacagagtccaaagagaggcggagaagggctattctgggcagaacaaacaattgatgactttatggctctgtggtctgggcagaactgcataaccctagatcaccaaagctgagagcctttaggagtgaggatttgggccaggcatggtggctcacgcctgtaatcccagcactttgggaggccgaggtgggtggatcacaaggtcaggagatcaagaccaacctgaccaacatggtgaaaccccatctctactaaaaatacaaaaattagctgacgtgatgcatgcacctgtaatcccagctactcaggaggctgaggcaggagaatcgcttgaacccgggaggtggaggttgcggtgagccgagattgcgccactgcactccagcctaggcgacagagcgagactccatctcaaaaaaaaaaaaaaaaaaaaaaaaagtgaggatttgggtcaccccaggctgaaggccaggggaacctgaagtggataagggaagggagaagacttaggccacaggatctgatgtagaaatggggctgacgtctccacctgtattttcttagctggaggagtgtgcaaagtttgaattacttctgccttctccttcttatttccttttcccttttaaaatagtcatcataatcataaaaatttcttttcca

SEQ ID NO: 1005 - DNA, 4169 bp, Homo sapiens
cggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatcctt

SEQ ID NO: 1006 - DNA, 3977 bp, Homo sapiens
cggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaaggtagagaaagaagagaaagaggaagaactagaggaagaggaggagaaagaagaggaggaggaagaagaaggaaatcaggagactgcagaattccttcttagtagtgaagaaatagaaacaaaagatgaaaaagaaatggataaagaaaataatgatggcagtagtgaaattggcaaggcagttggcttcctctctgttcccaagtctctctcatcagattctactttacttctgtttaaggacagctcttccaagatgggttactttcctactgaagaaaaatcagaaacagatgaaaactcaggcaagcagcctagcaaactggatgaggatgattcatgttcattgctaacaaaggagagcagccacaatagcagctttgagctgattggctccacgattccatcctatcagccttgcaacagacaaacaggccgtgggaccagttttttccctacagcaggaggattcagatctccttcccctgggctatttcgagccagtttggtcagctcagcttctaagagttcagggaaactgtctgagccttcacttcccatagaggattcccaggatctgtataacgcctccccagagcctaagacacttttcctaggagcaggagacttccagttctgtttagaagatgacactcagagccaactgttggatgcagatgggttcttaaatgttagaaaccacaggaatcagtaccaagctttgaagcctcgattgccattggccagtatggatgagaatgccatggatgccaacatggatgagctgttggatttgtgtactggaaagttcacatctcaggctgaaaaacatctacccaggaagagtgacaagaaagagaacatggaggaacttctgaacctttgttcaggaaaattcacttctcaggatgcctccactccagcctcatcagagttaaataaacaggagaaggagagcagcatgggtgatccaatggaagaagcacttgctctttgctcaggctcttttcccacagacaaggaagaggaagacgaggaggaggaatttggagactttcggcttgtttcaaatgataatgagtttgatagtgatgaggatgaacacagtgactctggtaatgatctggcactggaagaccatgaagatgatgatgaagaagaactcctgaagcgatctgagaagttgaaaaggcaaatgaggttgaggaaatacctggaggatgaggcagaggtgtcaggaagtgatgtgggaagcgaagatgagtatgatggggaagaaattgatgaatatgaagaggacgtaattgatgaagtacttccttctgatgaggaactgcagagtcaaatcaagaaaatacacatgaaaactatgttggatgatgataagcgacagctacgtttataccaagagaggtaccttgctgatggggatctgcacagcgatggtcctgggcgaatgaggaagtttcgatggaaaaacatagatgatgcttcccagatggacttgttccacagagactctgatgatgatcagactgaagaacagcttgatgagtcagaagccaggtggaggaaggagcgaattgaacgagagcagtggcttcgggacatggcacagcaggggaaaattacagctgaagaagaagaagaaattggggaggacagtcagtttatgatactggccaagaaagttacagccaaagcactgcagaagaatgccagtcgccctatggttattcaggaatcaaagtctttgctcagaaatccttttgaagccatcagaccaggaagtgctcaacaggtgaagacaggctcactgctaaaccagcccaaagctgtgcttcagaaactggctgctctctctgaccataaccccagtgctcctcgaaattcaagaaactttgtctttcatacactttctcctgtcaaggctgaggcggcaaaggaatcgtctaagtctcaggtaaagaaaaggggtccatctttcatgacttctccttcacctaagcacctcaaaacagatgatagcacttcaggattgacgcgaagcatcttcaaatatttggagagctaacaccatcaaaggtgccaaaatctacattgagactgctttgagaagtttctagcactgaaagttggaattgacactccagccaatgatcctt

SEQ ID NO: 1007 - DNA, 2054 bp, Homo sapiens
gacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaattggacccttgagtgaaggagattcagatgaagagatatttgtaagtaagaagttgaaaaacaggaaggttctacaagacagtgattccgaaacagaggacacaaatgcctctccagagaaaactacctatgacagtgccgaggaggaaaataaagagaatttatatgctgggaaaaatacaaaaatcaaaaggatttacaaaactgtggcagacagtgatgaaagttacatggaaaagtctttgtatcaggaaaatcttgaagcgcaagtgaaaccttgcttagagctgagtcttcagtctggaaactctacagactttaccactgacagaaagagttccaaaaagcacatacatgataaagaaggaactgcaggaaaagcaaaagtaaaatcaaaaagaagacttgagaaagaggagagaaaaatggaaaaaattagacagctaaaaaagaaggaaacaaaaaaccaggaagatgatgtagaacagccatttaatgacagtggctgtcttcttgtggataaagacctttttgaaactgggttggaggatgaaaataactctccattggaagatgaagagtcattagaatcaataagagcagctgtaaaaaacaaagtaaaaaagcacaagaaaaaagaaccatctttggagagtggggtccattcatttgaggaaggaagtgagttatcaaaaggaaccacgaggaaggaaagaaaggcagccagattaagtaaagaagcattaaaacaactgcatagtgagactcagcgccttattcgagagtctgcactgaaccttccatatcatatgcctgagaataaaaccattcatgatttcttcaaacgtaaaccccggcccacttgccacggaaatgccatggcactattgaagtcatctaaatatcagtcaagccatcacaaagaaatcatagacactgcaaatactactgaaatgaacagtgatcaccatagtaaaggttctgagcagacaacaggtgcagaaaatgaagtggaaactaatgcactccctgtagtttcaaaggaaacccagatcattactggatcagatgagtcttgcaggaaggatttggtaaaaaatgaagagctagaaattcaggagaaacagaagcagagtgacattagaccttcacctggggacagctcagtgttgcaacaggaatccaacttcctcgggaacaatcacagtgaggaatgtcaggttggagggcttgtagcatttgaacctcatgccctggagggtgaaggcccccaaaatccagaagaaacagatgagaaagtggaagagcctgagcagcaaaataaatcatcagcagttgggccacctgaaaaagtgagacggtttactctggatagacttaagcaactgggagtagatgtttccattaaaccacggctaggtgctgatgaagattcctttgtgatacttgaacctgaaaccaacagagaactggaagccttgaagcagcgtttctggaagcatgctaatccagcagccaaacccagggctggtcagacagtgaatgtgaacgtcatagtgaaagacatgggcactgatggaaaggaagagctaaaagcagatgtggtacctgtgactttagcacctaagaagttggatggagcaagccacacaaaaccaggtgaaaagcttcaggtgttaaaagctaaactgcaagaagcaatgaaactccgaaggtttgaggagcgccagaagcgccaagcactgtttaaattagataatgaagatgggtttgaggaagaggaggaggaagaggaagaaatgacagatgagtctgaggaagatggagaagagaagaaaaaaaaaaaaaaaaaaaaaaagaac

SEQ ID NO: 1008 - DNA, 2797 bp, Homo sapiens
catttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 1009 - DNA, 2169 bp, Homo sapiens
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 1010 - DNA, 4509 bp, Homo sapiens
aggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 1011 - DNA, 1556 bp, Homo sapiens
gtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 1012 - DNA, 1201 bp, Homo sapiens
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 1013 - DNA, 1201 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 1014 - DNA, 4693 bp, Homo sapiens
gtggaagcatttccgtcattctgagacagttgggctgaggcggttggtcgcctctctctctctctctctctgttcctcatctacattttgattggtttatttttgtattgttttctttcagtttccgataggtggagaacattctgctaatagcttttcttccagtccatttgtggcttgttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 1015 - DNA, 1521 bp, Homo sapiens
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatgataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 1016 - DNA, 1190 bp, Homo sapiens
atggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgta

SEQ ID NO: 1017 - DNA, 1331 bp, Homo sapiens
aggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaa

SEQ ID NO: 1018 - DNA, 4307 bp, Homo sapiens
gcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 1019 - DNA, 6480 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 1020 - DNA, 2233 bp, Homo sapiens
acttccagtgcgtgcagcgggagatcaagccgcacatgcggaagatgctggcttactggatgctggaggtaccgcccggacgcgtccccctcccccaccgctcccgggtctggacacaccggggccgccctgtcgggacatcccggtccccacagcaatctgcaggatgctccgaggctaagactcccggggcctggcctttcactagggcacccacgccagctgcctcccttgctttcccgagccctaatcggctcctcccgacagtgactgccagtcacttggcaccctaactgtgcctctcttcgggccgagcaaacgggaccaaggacactctctccccttcggcttctcacagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1021 - DNA, 2133 bp, Homo sapiens
ggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1022 - DNA, 2085 bp, Homo sapiens
attccacggttgctacatcgtcgcgaggggcggggcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgga

SEQ ID NO: 1023 - DNA, 1724 bp, Homo sapiens
gcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatca

SEQ ID NO: 1024 - DNA, 1843 bp, Homo sapiens
acctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1025 - DNA, 540 bp, Homo sapiens
tttattggtccttgtctctctaagtagcttaccctctctgccgtttttgctccctatcccacctcacttcagcgctcccacccccccgctgctgtgttccccacgctccagacccagcagtgactgtgcgccctcccccaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccg

SEQ ID NO: 1026 - DNA, 2394 bp, Homo sapiens
cacaggctagagtgcaatggcgcgatctcggttcactgcaacctccacctcccaggctcaagcgatcctcccgcctcagcctccggagtagctgggattacaggcgggcaccaccacgccccgctagtttttgtatttttagtagagaccgagtttcgccatgttggccaggctggtctcgaacacctaagctcaagcagtccgcggcctcggcctcacaaggtgctgggattacaggcgtgagctaccgcgccagcctcacgtgaccttttgagagtgaagtgttctggggccttcagtggcttggttgtgggccaggaaaacgcgcccggtttcactgagttaaaagaaacctattttaatatgaaaatcggttcttataaagagcataccaggagatcatctacactcgcagggttttccaaacttgtcttattattagtaacacctggctgggcccagcccaatcccagtgacttcactctctggaagaggggcttgggaatctttctcattaaggagctccccagatgattcttctgagcgagtaatgttgggaaaccctggagcatccagcctggtgattttgtgctgagggccgccccgcctgtcaatggcccacttggaagtagagcctggaccacctagtccaagtctatcgctgcatcctgctgccttcgcgccctcgacccgcaagtatttgcgaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgg

SEQ ID NO: 1027 - DNA, 1394 bp, Homo sapiens
agagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatc

SEQ ID NO: 1028 - DNA, 1948 bp, Homo sapiens
agcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgag

SEQ ID NO: 1029 - DNA, 2726 bp, Homo sapiens
gcgtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagt

SEQ ID NO: 1030 - DNA, 1807 bp, Homo sapiens
gcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgagcttgagtcttcctgaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttg

SEQ ID NO: 1031 - DNA, 1361 bp, Homo sapiens
gtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctgtgcatgatttcttcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaa

SEQ ID NO: 1032 - DNA, 1777 bp, Homo sapiens
gtgctcacccggcccggtgccacccgggtccacagggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgag

SEQ ID NO: 1033 - DNA, 3330 bp, Homo sapiens
ccgcgaggctccgtctccccggcgcggcccgctcgccgtccggctcgctcagggcctgggcagacgcggcccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattagaggtgtgtcaaaaattaagttttgttggtacaagtaatataaagctacctacgtgctaacaacgatacagtttaatgattaactgaacctcttaactgtaaaacccaggagtcttggaaaaaaattaacataaagattaaccagggccactctcaaggaaagatggactgctgagccatagtttatggaattacttaagtggcattttaatatattaagtaaattcatgtaaatttatttgaaagtataagtaagctctacatggcgatttttagagttaaactagggctccacttgttaatgtgcaaaaataactggt

SEQ ID NO: 1034 - DNA, 1733 bp, Homo sapiens
gagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtacc

SEQ ID NO: 1035 - DNA, 13506 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 1036 - DNA, 13413 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 1037 - DNA, 1735 bp, Homo sapiens
gtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagaacattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattc

SEQ ID NO: 1038 - DNA, 917 bp, Homo sapiens
atgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 1039 - DNA, 2503 bp, Homo sapiens
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 1040 - DNA, 4744 bp, Homo sapiens
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaag

SEQ ID NO: 1041 - DNA, 5191 bp, Homo sapiens
aggactagagagcgagccgcaaggaagtcggtgcagtcgagacccccctccccatcccagcgcatcgcgtctccgccgagcttgagggcacgccggggacccctccccagagccggccggaccccaggtgccgaggccttggggagcgcggggcgtcccgggtcgcggtgccctcgggacgagacagcccctggcagtgccaccaccgcagccgccgggcgatctccaagcggcgatctctaagcgctgctctctgctcggccgcgggccaggaggggagggtccggccttgccccgcaggcgtccattggcggcttcccccggcctccgcgccatgccgcgggccgtgtgaaaggcggcagcaccggaacccgcaggtgtccgcgggcgcgccaagcccttttgggtagggggcgccttactcgctatgctgcaagggccccgggccttggcttcggccgctgggcagaccccgaaggtggtgcccgcgatgagccccacagagctgtggccatccggcctcagcagcccccagctctgcccagctactgctacctactacacaccgctgtacccgcagacggcgcctcccgcagcggcgccaggcacctgcctcgacgccactccccacggacccgagggccaagttgtgcgatgcctgccggcaggccggctgccggccaaaaggaagctggatctggaggggattgggaggcccgtcgtccctgagttcccaacccccaaggggaagtgcatcagagtggatggcctccccagccccaaaacccccaaatcccccggggagaagactcggtatgacacttcgctggggctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtaggcaggggaatgtttgaagaccccaccagacctgggaagcagcaacagctggggcaggagctgaaggagctgatgaacacggagcaggccttggaccagctcatccagagctgctctctgagcttcaagcacctgactgaggacaaggccaacaagaggctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttctttttttttttttttgagatggagtctcgctctgttgcccaggctggagtgcagtggcctgatctcggctcactgcaacctctgcctcccaggttcaagcgattcttctgcctcagcctccagagtagctgggactatagacatgcaccaccacgcccggctaattttgtatttttggtcgagacggggttttgccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctggg

SEQ ID NO: 1042 - DNA, 1078 bp, Homo sapiens
atgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggatgactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtg

SEQ ID NO: 1043 - DNA, 4094 bp, Homo sapiens
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagcggcggcggcggcggccctccggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 1044 - DNA, 2100 bp, Homo sapiens
gcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 1045 - DNA, 3218 bp, Homo sapiens
atgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 1046 - DNA, 1728 bp, Homo sapiens
cgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacatt

SEQ ID NO: 1047 - DNA, 1890 bp, Homo sapiens
gcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaa

SEQ ID NO: 1048 - DNA, 1094 bp, Homo sapiens
aagcaagcctcttataggcagcataagttgagtgtttttaaaaatccatttaactactttgcctttttattggagaacttaatccacttacgttcagggttatcattcataggctgctgatactttggctgtgaggcaaaaaaggagaatttatgatatcaccaatgtcttagagggaattgacttgattgaaaaaaagtcaaaaaacagtatccagtggaaaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaaggg

SEQ ID NO: 1049 - DNA, 674 bp, Homo sapiens
tcctatgacagtacattttcctatgtaactcatgaagacatctgtaattgctttaatggtgatacacttttggccattcaggcaccttctggtacacaactggaggtacccattccagaaatgggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcagcaggatctattagtggagatatcattgatgagttaatgtcttctgacgtgtttcctctcttaaggctttctcctaccccggcagatgactacaactttaatttagatgataacgaaggagtttgtgatctgtttgatgtccagatactaaattattagattccatggaaacttgggactgttatctacctctaactgttgaccaaaatctttctaggctacagtgctgtcatcccgcatctatacaagaaacctggatcaaatacttttagtcccttctaaca

SEQ ID NO: 1050 - DNA, 4145 bp, Homo sapiens
ctggtttcggaaatgcccttacagcagcaggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgt

SEQ ID NO: 1051 - DNA, 1050 bp, Homo sapiens
atgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 1052 - DNA, 791 bp, Homo sapiens
atgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 1053 - DNA, 5219 bp, Homo sapiens
gtcagagcggcgtcgggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctga

SEQ ID NO: 1054 - DNA, 5008 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 1055 - DNA, 5102 bp, Homo sapiens
ggcctggcgggaaagtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 1056 - DNA, 5185 bp, Homo sapiens
gtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 1057 - DNA, 1683 bp, Homo sapiens
gtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaacttgtgtatgcggatacctgcttcagtaccatcaagttaaaagcagaagatgcttctggtagagagcatttaatcactctcaagttgaaggcaaagtatcctgcagaatcaccagattattttgtggattttcctgttccattttgtgcctcctggacacctcagagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatgtggtaaaacccctgggaattaagctgagcaggaacatacatttgtgggatccagaaaatagtgtgttacaaaatttgaaagatgttttagaaattgattttccagctcgtgctatcctggaaaaatctgattttactatggattgtggaatttgttatgcttatcaacttgacggtaccattcctgatcaagtgtgtgataattctcagtgtggacaacctttccatcaaatatgcttatatgagtggctgagaggactactaactagtagacagagttttaacatcatatttggtgaatgtccatattgtagtaagccaattaccttaaaaatgtctggaaggaaacactgaaataagaatacaacatttcggtgaagagctggaaacttaaaaaattatcaaaaggaattttggtatcatcttcagagaaaaaataaagcaagaaatactaacatcaaaaggacaggtatgatgatgcgataataataaacatctgcgtttgtctcttcactaagagtaaactgggaaattgtaggccaaagtccagttgaactttctaagtctgtgatccccgtgctgactgtggaagtgtatttataccaagatggagatcttgacttcttgaatatatctggactggtaaaatcttgatgaggctcataaaatgagtttgggaattgtgtatagctgattttttgtgggaaactgtttacttcattcaaaggttcttgagactcttgatatttctgtcttctccttgtgctttcctatggaaaaaatacatatatagtttagtttgttagacgtgagttatccaagtatttattttgtgtagtgtgtaagaatgctaaataaaatgttatacaaga

SEQ ID NO: 1058 - DNA, 906 bp, Homo sapiens
agcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatacttagtggataccatcgaatagtacaacagagaatgcagcactctcctgatctaatgagctttatgatggagttgaagatgcttttggaagttgccttaaagaatagacaagagctgtatgcactacctcctcctccccagttctactcaagccttattgaagagataggaactcttggttgggataaagctccttaataagcatttatagtcagtttttggcagcaatagaatcactaaaggcattctgggatgttatggatgaaatcgatgagaagacctgggtacttgagccagaaaaacctccacggagtgcaacagcacgcagaattgcattaggtaataatgtttccataaatatagaggtagaccccaggcatcctactatgcttcctgagtgcttctttcttggagctgaccatggtatgacatctgagatttaaacgttttttaatagagtcataaaatccttgcctagcattgttaaattattagacaatattagtatattaatggtagtttttattttttgtctgagacggagttttgctcttgttgcccagtatgtagtgtaatggcgcgatctcggttcaccgcaataatgatagttattttaaatgacaatgtctcagcattctgaactgtataattttgttttttaacataatacatataatt

SEQ ID NO: 1059 - DNA, 1496 bp, Homo sapiens
ctgactccaggagctggggtcaaattgctggagcaggctgatttgcatagcccaatggccaagctgcatgcaaatgaggcggaaggtggttggctgagggttggcaggataaccccggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 1060 - DNA, 1375 bp, Homo sapiens
tcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctg

SEQ ID NO: 1061 - DNA, 803 bp, Homo sapiens
agtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgc

SEQ ID NO: 1062 - DNA, 1361 bp, Homo sapiens
cgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 1063 - DNA, 7198 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 1064 - DNA, 966 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1065 - DNA, 1582 bp, Homo sapiens
gcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 1066 - DNA, 1076 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggacttattactaggagtatatcaagttactgtgtatcaggcaggggagagtgatacagattcatttgaagaagatcctgaaatttccttagctcattatttatag

SEQ ID NO: 1067 - DNA, 798 bp, Homo sapiens
atgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1068 - DNA, 1401 bp, Homo sapiens
atgtgcaataccaacatgtctgtacctactgatggtgctgtaaccacctcacagattccagcttcggaacaagagaccctggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1069 - DNA, 6853 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 1070 - DNA, 754 bp, Homo sapiens
ctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcctaaagaaaaggaataagccctgcccagtatgtagacaaccaattcaaatgattgtgctaacttatttcccctag

SEQ ID NO: 1071 - DNA, 891 bp, Homo sapiens
atgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1072 - DNA, 732 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1073 - DNA, 1171 bp, Homo sapiens
ctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtctt

SEQ ID NO: 1074 - DNA, 657 bp, Homo sapiens
atgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1075 - DNA, 842 bp, Homo sapiens
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattgg

SEQ ID NO: 1076 - DNA, 6700 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 1077 - DNA, 7381 bp, Homo sapiens
ggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcaga

SEQ ID NO: 1078 - DNA, 393 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 1079 - DNA, 845 bp, Homo sapiens
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaa

SEQ ID NO: 1080 - DNA, 6778 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 1081 - DNA, 7228 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 1082 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1083 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 1084 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 1085 - DNA, 582 bp, Homo sapiens
gtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttc

SEQ ID NO: 1086 - DNA, 583 bp, Homo sapiens
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 1087 - DNA, 582 bp, Homo sapiens
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 1088 - DNA, 582 bp, Homo sapiens; identical to SEQ ID NO: 1085

SEQ ID NO: 1089 - DNA, 916 bp, Homo sapiens
acatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtcccc

SEQ ID NO: 1090 - DNA, 582 bp, Homo sapiens; identical to SEQ ID NO: 1087

SEQ ID NO: 1091 - DNA, 916 bp, Homo sapiens; identical to SEQ ID NO: 1089

SEQ ID NO: 1092 - DNA, 916 bp, Homo sapiens; identical to SEQ ID NO: 1089

SEQ ID NO: 1093 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 1094 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 1095 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 1096 - DNA, 582 bp, Homo sapiens; identical to SEQ ID NO: 1085

SEQ ID NO: 1097 - DNA, 583 bp, Homo sapiens; identical to SEQ ID NO: 1086

SEQ ID NO: 1098 - DNA, 583 bp, Homo sapiens; identical to SEQ ID NO: 1086

SEQ ID NO: 1099 - DNA, 582 bp, Homo sapiens; identical to SEQ ID NO: 1087

SEQ ID NO: 1100 - DNA, 582 bp, Homo sapiens; identical to SEQ ID NO: 1085

SEQ ID NO: 1101 - DNA, 583 bp, Homo sapiens
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacaatttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 1102 - DNA, 582 bp, Homo sapiens; identical to SEQ ID NO: 1085

SEQ ID NO: 1103 - DNA, 582 bp, Homo sapiens
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 1104 - DNA, 916 bp, Homo sapiens; identical to SEQ ID NO: 1089

SEQ ID NO: 1105 - DNA, 7576 bp, Homo sapiens; identical to SEQ ID NO: 1094

SEQ ID NO: 1106 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1107 - DNA, 583 bp, Homo sapiens; identical to SEQ ID NO: 1086

SEQ ID NO: 1108 - DNA, 582 bp, Homo sapiens; identical to SEQ ID NO: 1085

SEQ ID NO: 1109 - DNA, 582 bp, Homo sapiens; identical to SEQ ID NO: 1087

SEQ ID NO: 1110 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 1111 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 1112 - DNA, 583 bp, Homo sapiens; identical to SEQ ID NO: 1086

SEQ ID NO: 1113 - DNA, 582 bp, Homo sapiens; identical to SEQ ID NO: 1087

SEQ ID NO: 1114 - DNA, 7576 bp, Homo sapiens; identical to SEQ ID NO: 1093

SEQ ID NO: 1115 - DNA, 582 bp, Homo sapiens; identical to SEQ ID NO: 1085

SEQ ID NO: 1116 - DNA, 916 bp, Homo sapiens; identical to SEQ ID NO: 1089

SEQ ID NO: 1117 - DNA, 916 bp, Homo sapiens; identical to SEQ ID NO: 1089

SEQ ID NO: 1118 - DNA, 582 bp, Homo sapiens; identical to SEQ ID NO: 1087

SEQ ID NO: 1119 - DNA, 916 bp, Homo sapiens; identical to SEQ ID NO: 1089

SEQ ID NO: 1120 - DNA, 582 bp, Homo sapiens; identical to SEQ ID NO: 1085

SEQ ID NO: 1121 - DNA, 916 bp, Homo sapiens; identical to SEQ ID NO: 1089

SEQ ID NO: 1122 - DNA, 7576 bp, Homo sapiens; identical to SEQ ID NO: 1093

SEQ ID NO: 1123 - DNA, 583 bp, Homo sapiens; identical to SEQ ID NO: 1086

SEQ ID NO: 1124 - DNA, 1172 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacctgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccacacagaggaggcctcctcagctgccagaagaggtgccactgtagaggc

SEQ ID NO: 1125 - DNA, 582 bp, Homo sapiens; identical to SEQ ID NO: 1087

SEQ ID NO: 1126 - DNA, 583 bp, Homo sapiens; identical to SEQ ID NO: 1086

SEQ ID NO: 1127 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1128 - DNA, 1172 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccacacagaggaggcctcctcagctgccagaagaggtgccactgtagaggc

SEQ ID NO: 1129 - DNA, 6506 bp, Homo sapiens; identical to SEQ ID NO: 1127

SEQ ID NO: 1130 - DNA, 1172 bp, Homo sapiens; identical to SEQ ID NO: 1128

SEQ ID NO: 1131 - DNA, 1172 bp, Homo sapiens; identical to SEQ ID NO: 1128

SEQ ID NO: 1132 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 1133 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1134 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 1135 - DNA, 6506 bp, Homo sapiens; identical to SEQ ID NO: 1127

SEQ ID NO: 1136 - DNA, 3751 bp, Homo sapiens; identical to SEQ ID NO: 1134

SEQ ID NO: 1137 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1138 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1139 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 1140 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1141 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 1142 - DNA, 850 bp, Homo sapiens
gaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctacca

SEQ ID NO: 1143 - DNA, 850 bp, Homo sapiens; identical to SEQ ID NO: 1142

SEQ ID NO: 1144 - DNA, 850 bp, Homo sapiens; identical to SEQ ID NO: 1142

SEQ ID NO: 1145 - DNA, 3751 bp, Homo sapiens; identical to SEQ ID NO: 1132

SEQ ID NO: 1146 - DNA, 5648 bp, Homo sapiens; identical to SEQ ID NO: 1139

SEQ ID NO: 1147 - DNA, 6575 bp, Homo sapiens; identical to SEQ ID NO: 1138

SEQ ID NO: 1148 - DNA, 5648 bp, Homo sapiens; identical to SEQ ID NO: 1095

SEQ ID NO: 1149 - DNA, 5648 bp, Homo sapiens; identical to SEQ ID NO: 1095

SEQ ID NO: 1150 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 1151 - DNA, 1172 bp, Homo sapiens; identical to SEQ ID NO: 1128

SEQ ID NO: 1152 - DNA, 1172 bp, Homo sapiens; identical to SEQ ID NO: 1128

SEQ ID NO: 1153 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcgtctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1154 - DNA, 5648 bp, Homo sapiens; identical to SEQ ID NO: 1095

SEQ ID NO: 1155 - DNA, 6506 bp, Homo sapiens; identical to SEQ ID NO: 1153

SEQ ID NO: 1156 - DNA, 850 bp, Homo sapiens
gaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctacca

SEQ ID NO: 1157 - DNA, 850 bp, Homo sapiens; identical to SEQ ID NO: 1142

SEQ ID NO: 1158 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagagggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgcgctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 1159 - DNA, 6575 bp, Homo sapiens; identical to SEQ ID NO: 1133

SEQ ID NO: 1160 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 1161 - DNA, 1172 bp, Homo sapiens; identical to SEQ ID NO: 1128

SEQ ID NO: 1162 - DNA, 1172 bp, Homo sapiens; identical to SEQ ID NO: 1128

SEQ ID NO: 1163 - DNA, 850 bp, Homo sapiens; identical to SEQ ID NO: 1142

SEQ ID NO: 1164 - DNA, 850 bp, Homo sapiens; identical to SEQ ID NO: 1142

SEQ ID NO: 1165 - DNA, 6575 bp, Homo sapiens; identical to SEQ ID NO: 1138

SEQ ID NO: 1166 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 1167 - DNA, 3751 bp, Homo sapiens; identical to SEQ ID NO: 1134

SEQ ID NO: 1168 - DNA, 4666 bp, Homo sapiens
aagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagggaaagggatgaagaaaatcaagaaatgtcttcatgcaaatcagcaagaatagaaacgtcttgttctcttttagaacaaacacaacctgctacaccctcattgtggaaaaataaggagcagcatctatctgagaatgagcctgtggacacaaactcagacaataacttatttacagatacagatttaaaatctattgtgaaaaattctgccagtaaatctcatgctgcagaaaagctaagatcaaataaaaaaagggaaatggatgatgtggccatagaagatgaagtattggaacagttattcaaggacacaaaaccagagttagaaattgatgtgaaagttcaaaaacaggaggaagatgtcaatgttagaaaaaggccaaggatggatatagaaacaaatgacactttcagtgatgaagcagtaccagaaagtagcaaaatatctcaagaaaatgaaattgggaagaaacgtgaactcaaggaagactcactatggtcagctaaagaaatatctaacaatgacaaacttcaggatgatagtgagatgcttccaaaaaagctgttattgactgaatttagatcactggtgattaaaaactctacttccagaaatccatctggcataaatgatgattatggtcaactaaaaaatttcaagaaattcaaaaaggtcacatatcctggagcaggaaaacttccacacatcattggaggatcagatctaatagctcatcatgctcgaaagaatacagaactagaagagtggctaaggcaggaaatggaggtacaaaatcaacatgcaaaagaagagtctcttgctgatgatctttttagatacaatccttatttaaaaaggagaagataactgaggattttaaaaagaagccatggaaaaacttcctagtaagcatctacttcaggccaacaaggttatatgaatatatagtgtatagaagcgatttaagttacaatgttttatggcctaaatttattaaataaaatgcacaaaactttgattcttttgtatgtaacaattgtttgttctgttttcaggctttgtcattgcatctttttttcatttttaaatgtgttttgtttattaaatagttaatatagtcacagttcaaaattctaaatgtacgtaaggtaaagactaaagtcacccttccaccattgtcctagctacttggttcccctcagaaaaaaattcatgatactcatttcttatgaatctttccagggatttttgagtcctattcaaattcctatttttaaataatttcctacacaaatgatagcataacatatgcagtgttctacaccttgcttttttacttagtagattaaaaattataggaatatcaatataatgtttttaatattttttcttttccattatgctgtagtcttacctaaactctggtgatccaaacaaaatggcttcagtggtgcagatgtcacctacatgttattctagtactagaaactgaagaccatgtggagacttcatcaaacatgggtttagttttcaccagaatggaaagacctgtacccctttttggtggtcttactgagctgggtgggtgtctgttttgagcttatttagagtcctagttttcctacttataaagtagaaatggtgagattgttttctttttctaccttaaagggagatggtaagaaacaatgaatgtcttttttcaaactttattgacaagtgattttcaagtctgtgttcaaaaatatattcatgtacctgtgatccagcaagaagggagttccagtcaagagtcactacaactgattagttgtttagagaatgagaaatggaacagtgaggaatggaggccatatttccatgacttcccttgtaaacagaagcaacagaagggacaagaggctggcctctacatcactctcaccttccaaatcttgtggaagtgcatctacttgccagaaccaaattaacttacttccaagttctggctgcttgcaggtggaactccagctgcaagggagttagggaaatgaaggtctttttttaaaagcttctcagccttcctagggaacagaaattgggtgagccaatctgcaatttctactacaggcattgagaccagttagattattgaaatattatagagagttatgaacacttaaattatgatagtggtatgacattggatagaacatgggatactttagaagtagaattgacagggcatattagttgatgaaatggagtcatttgagtctcttaatagccatgtatcataattaccaagtgaagctggtggaacatatggtctccattttacagttaaggaatataatggacagattaatattgttctctgtcatgcccacaatccctttctaaggaagactgccctactatagcagtttttatatttgtcaatttatgaatataatgaatgagagttctggtacctcctgtctttacaaatattggtgttgtcagtatttttcctttttaaccattccaatcggtgtgtagtgatgtttcattttggttttaatttgtatatccctgatagctataattgggtcatagaaattctttatacattctagatgcaagtctcttgtcggatatatgtattgagatattacacctagtctgtggcttgactgttttctttatgtcttttgatgaatagaagttttaaattttgacaaggtcaaatttatttttttcttttgtttgatattttttctctccaatttaaccccaagatttcagatattctgctctattatataaactttatatttttatatttgtgatctaccttgaattgatatgtatgttgtgaattatggatcagggttctttttttcccccatacaagtatccagtcattgtaacactgtttattgaaagaattatcctttcctcattaaattaccttgccaattagtaaaaaatcaattaaccataatggtggatctgtttctggactttctgtttggttacactgaaatgtttgtccatccttgcactcactcataccatactgccttgaattactgtagctgcatagatgctccttaagttgggattacattgtaataaacgcaatgtaagtt

SEQ ID NO: 1169 - DNA, 1544 bp, Homo sapiens
gagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggagaaccatacagacttttgactggcgttgagtacgttgttggaaggaaaaactgtgccattctgattgaaaatgatcagtcgatcagccgaaatcatgctgtgttaactgctaacttttctgtaaccaacctgagtcaaacagatgaaatccctgtattgacattaaaagataattctaagtatggtacctttgttaatgaggaaaaaatgcagaatggcttttcccgaactttgaagtcgggggatggtattacttttggagtgtttggaagtaaattcagaatagagtatgagcctttggttgcatgctcttcttgtttagatgtctctgggaaaactgctttaaatcaagctatattgcaacttggaggatttactgtaaacaattggacagaagaatgcactcaccttgtcatggtatcagtgaaagttaccattaaaacaatatgtgcactcatttgtggacgtccaattgtaaagccagaatattttactgaattcctgaaagcagttgagtccaagaagcagcctccacaaattgaaagtttttacccacctcttgatgaaccatctattggaagtaaaaatgttgatctgtcaggacggcaggaaagaaaacaaatcttcaaagggaaaacatttatatttttgaatgccaaacagcataagaaattgagttccgcagttgtctttggaggtggggaagctaggttgataacagaagagaatgaagaagaacataatttctttttggctccgggaacgtgtgttgttgatacaggaataacaaactcacagaccttaattcctgactgtcagaagaaatggattcagtcaataatggatatgctccaaaggcaaggtcttagacctattcctgaagcagaaattggattggcggtgattttcatgactacaaagaattactgtgatcctcagggccatcccagtacaggattaaagacaacaactccaggaccaagcctttcacaaggcgtgtcagttgatgaaaaactaatgccaagcgccccagtgaacactacaacatacgtagctgacacagaatcagagcaagcagatacatgggatttgagtgaaaggccaaaagaaatcaaagtctccaaaatggaacaaaaattcagaatgctttcacaagatgcacccactgtaaaggagtcctgcaaaacaagctctaataataatagtatggtatcaaatactttggctaagatgagaatcccaaactatcagctttcaccaactaaattgccaagtataaataaaagtaaagatagggcttctcagcagcagcagaccaactccatcagaaactactttcagccgtctaccaaaaaaagagagagactccatctcaaaaaaaaaaaaaaaaaaaag

SEQ ID NO: 1170 - DNA, 3225 bp, Homo sapiens
cgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaaggtaaggtgaataggctaaaagttggatttcagattaacagtcagtaactgttaatcctgcctctttttttttttttcttttttggccaagttactactatactaataaaatatgaaatgttaactatg

SEQ ID NO: 1171 - DNA, 5684 bp, Homo sapiens
gggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctgtaatcccaggactttgggaggccaaggcgggcagatcaccggaggtcaggagttcgagaccagcctgaccaacatggagaaaccccatctctactaaaaatacaaaattagccgggtgtggtggcgcatgcctgtaatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactagggatgctttccaaaatatcacctctttaacgtttactttttctagtgtgtgtctggaatccaaaggacatgaataagccactcataattaattttgagaagttttatcaaatgtttatgtttctaactgcaaaccttaattttggaaaggcacaatgtttaactcacctatgtttaaccatggctaatttaaaatagtctaagatttggccgtcactaattagtattctcaagaatttcatttttcaattttaagaagaaaagggattttggtcacattttgcttgtaaatgaaaattacatcctcattctttgtgtagtatctacacattgttataagccaaaaaacaaagtctgtctggaatctttgtacatatttgtatgttgctataattgttatttttatcttcattattgtgcaaaatataaatgagcatttgtacattgactgtataagaaaccatgggccaggtcctgtggctcatgcctataatcccaacactttgggaggctgaggcaggaggattgcttcagtccaggagttcaagactaacctgggcaacatagccctcatctctacaaaaaataaaaaaattagttgggtgtgatggcatgtgcctgtagtcccagctactcaggagactgacatgagaggatcacttgagactgggagattctgaggctgcagtgagctgtgattgcaccactacactccatcctaggtgagagggcaagaccctttctcagaaaaggaaaaaaagaaattctggacatgtttttatcagttttcaggacttggtatcaatgtacatagaatggctaataaaaattggaattgagattattgaaaaaaaa

SEQ ID NO: 1172 - DNA, 4876 bp, Homo sapiens
gcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaatta

SEQ ID NO: 1173 - DNA, 4465 bp, Homo sapiens
gagagcttacagtacagtcagcgagatgaggcaggtatgaagattccagtgcatgcaatgcagtgtgttataaaagtcccatgactaccagagggaatacagatgtaaaacttaggaggaaaagaaatcactctggatgagccagtcaggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagtttatggagtctcgctgtgtcgcccaggctggaatgcagtggcatgatctcggctcactgcaacctctgcctcccaggttcaagcgattcttctgcctcagcctcctgagtagctgtgaatacagtaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaat

SEQ ID NO: 1174 - DNA, 1995 bp, Homo sapiens
atttaaacctgaggccatttgatttctcaagtcgttttataattaatttgtagaaagagtcgggcaaataggtccaggatgcaaagcctaaccaagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatct

SEQ ID NO: 1175 - DNA, 2098 bp, Homo sapiens
acacatgaggaaccaagtatattttaatattaaacctctttatagaagaaccaagcaagttggtttggctgtatcaatgcacagtttaatgtgttgattatcgtttgcctctttggcagagaagaatttttttttctctttagttcatttaagttgatttgttgaatgtttccatctatacaaaaaaagaattgctttgtatacgctgaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcatagga

SEQ ID NO: 1176 - DNA, 600 bp, Homo sapiens
ccgaaggtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaa

SEQ ID NO: 1177 - DNA, 1344 bp, Homo sapiens
gggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 1178 - DNA, 1359 bp, Homo sapiens
ccgcggatggccggagctggcgccctggttctggaggtaaccggttactgagggcgagaagcgccacccggaggctctagcctgacaaatgcttgctgacctgggccagagctcttcccttacgcaagtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccagtatgtccaaaatactaaaatgcgccggcaatgaagatatcattacactaagggccgaagataacgcggataccttggcgctagtatttgaagcaccaaaccaggagaaagtttcagactatgaaatgaagttgatggatttagatgttgaacaacttggaattccagaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgttaccatagagatgaatgaaccagttcaactaacttttgcactgaggtacctgaacttctttacaaaagccactccactctcttcaacggtgacactcagtatgtctgcagatgtaccccttgttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatctggtctagttaacctagaagtatttttgtctcttagaaatacttgtgatttttataatacaaaagggtcttgactctaaatgcagttttaagaattgtttttgaatttaaataaagttacttgaatttcaaacatca

SEQ ID NO: 1179 - DNA, 2119 bp, Homo sapiens
gggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 1180 - DNA, 4840 bp, Homo sapiens
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaatggtctgatgttgtgttctttgtattaagtacactaatgttctcttttctgtctaggagaagatagatagaagataactctcctagtatctcatcc

SEQ ID NO: 1181 - DNA, 480 bp, Homo sapiens
tccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatac

SEQ ID NO: 1182 - DNA, 3150 bp, Homo sapiens
gctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttcc

SEQ ID NO: 1183 - DNA, 9784 bp, Homo sapiens
aggcctggacgtattctcgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaaggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggaaaaatccaagctggagagtgagctagccaactttgggcctcgcattaatgatatcaagaggatcattcagagccgagagagggaaatgaaagacttgaaggagaagatgaaccaggtagaggatgaggtgtttgaagagttttgtcgggagattggtgtgcgcaacatccgggagtttgaggaagaaaaggtgaaacggcagaatgaaatcgccaagaagcgtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaaggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagagggtagctcccagggggaggactcagtgagtggttcacagagaatttccagtatctatgcacgagaggccctcattgagattgactacggtgatctgtgtgaggatctgaaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatgagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacagctacaagccagcccccttcttcgtcctggatgagattgatgctgccttggataacaccaacattggcaaggtggcaaattacatcaaggagcagtcgacttgcaacttccaggccatcgtcatctctctcaaggaggagttctacaccaaggccgagagcctcattggagtctatcctgagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaaacctgtagcttcaatcatgtctggtaaccgggtgcctgagccccaatctgggttgtgaggaaataggggagaggtatcctgggccacatcccagcctaacacctgtgaggttcattttaggaactaacctcattagctataaggatcatgcagaggcagcaaagccgggtgcgatgagctcagcctttactcattcacatacaccatcacactttaattccaatctgtatattgctttttaaaagttaagtccattctaattacccaaatatgcatgaattcattctccttttgagaagttagattgttaaagatagtctcattcagctaccaaccactccttgatccttcccttcttagtggctgttgtttgttgtacttccgtttagactttgttttaatgcttgtacgtacatatgtgaactcattggaaatattgtgtgtttaatgcaaatgatatattgaattgtttagcaatttgttttctttgcttaacgatgtttttgagatctgtgcatgttacttaatgtagctcaatccatcttctgtaattgctgtatagattgtcatcatatgattaccacattttacttacgcatttcttttgtgatggacattaagactgtttttaggttttgctattacaaaatactacacaggagcatcactatgcctgtgtgaaagtatatgtatgaaagtttacctagggttgattcctagaagtggaattgcaaagtcataggatatttatatattggtttttaataatacttccaaattgccctcctgtactatttactcagtatttttcttgaggttgatctgaggtctaacattgttatcctatatcattttcatcccaagtagtgatatctgtgaaatcacaggtttgatgtgtgctaattatgtattcttctaatacatattaaaagacataactatcaaaacaaaataaatttgtctgttttcaaccaaagaagtcacgtaccactggtggtactgtgtgccataatttggcaaatgctggcctttatggacgagcacaattcgggggtcagacctggttcaaattctagctgtagaaacttgtgcaagttacttcacctctgagcctaagtttccacatctgtaaaaggagataataaacacctaccttgcagtagtgaagcaaagagaaaattaaatatatatgaagcaatttggctggcatctagatcattcacagccctttaaaggtcacctttgctgttctccccactttacagataaggaaactgaggcccaaaaaggtttgaacccaggtcttccaagtcattcaagtgctttctccactgtacaggtggttatcaaccttggctgcgcatcagaatcgtttgtaaagctttttctttttcctttttaaaaagtaaagcaatatatacacaggtaaaaaaataaaatagtacagaagggcttataatgagaagcagcagttccctgcttgcacccccacatccaaaggatgtggagctctttaaaaataaattgctctggtcccacctctggaaatctgattcagccagcatggataataacccagataactaacccctacctcacaggataaaaaggattacatgagatgccttaggctaaggccctggcacacaggaacacatgtgctacaaaggagctttggggacttaagtcctgaggatccaggaggtgaggtgacttgtccaagattccactggtttagtggcagagcctagacttccactcggatctatttagtgcttgccccctgctctctcctgtcgtgccccaccacctcctggcatcacagggcaaccgttgtcaaggctatgctcacgggaggctgggcaccacagtgtttccaagagcaagctggatccgagtagattccctagggcttgttggaggaactagtttgactcccttatactgtggacgcagtagccttgctgtagggagttgaagagtactccacaacagtatcttaagtttaactgggcacttccctctggaaatcacagtgttgtgcaccaggaacacaaagatgagtcaaatctttatcctgcctttgaggagctcactgtttagttggggaaaccatttgtaaaacagccattaaccatacagtgtgatcaacactgacaggagcacaggaaaaacatctagcttatgtgaagattcagagaaggcatcctgtagtctaggtggtgatacctgaactgagtcttgagggacgggtaggaattagccagttgaggaagtagaaggaatttccagatattggaaacagtatgcatgaagacatgaaggcaagaaacagcaaaacaaatactgaagcatgaagattcctggggtggggggaaagcagcaagaaaaggtagagaggaaccagattggaagagggtcgtaaatgcatggctacagaattcagatttgttttgtaggacagtgtggttcccaaactggctgtataccacaaacaggtacggcattctgggccccggcccctaaaacattcattaagtctggggtgaagatttggaatcttgaatgcttataaaggttaccacatgactagggtacagccagatttggaaaccatagcttgaaggcagtgagggagccatgaaatggtttttaatagggggactccagatcagatgtgaacttaacctgtttctggctggctagccaaccagcatggaaaacagattaggttagatgttcatgctgtatgtgcccgtgcctgtagcttccctgttaatcagcttcttacactactatatttgcttattttgtctctgaataagctttaggcaccacaagggtgggcctggggatattttgcttaccagtatagcccctgcaaaaaagcacagtgcctgacacaaaacaggcacccagtaaagtttttgaatgaatgaatgcatgagtgaatccatttgtgagagagcgaatggagatgacaagattagctaggagactggaaaaagaccaggaggcctgcactagggcaaaggccagtaggaatagattggaggtgttaaggtgtgaactgttaaggtaagatgataacttaatgactgattattggatgtggagggtgactgagaggatagaatgagtacccatgaatagccatgattcctaccctgtcccagtcatctctttccttatccatctctgaaacaatctgcttacatcctcctcagcaactggaattcctcaagttagttagacattctgtgtgctgtgtggtctctcactgcccccccactccccacccctccacaagccattgattcattcatccagttcaataaatcttggctaagcacctccagtgtgcagtaaggctcttccaagccaggactctgactccctctttcctacctcaagagatgtttttgagggctttcccaggtaagagtcacatctcttatacaataacttatagtgagatacccagaatgtcagacttgtaagggaagactgcccaaaccccttctgaggtcctcagaggggaattaacttcctaaggtccgactgctaggaagtgttggagccagaaatggaacctaggtttcctttctatgtcatctctggagtcttgatcttgatctatcccattgtagatcaggacaggcagaggtggtcagggagaaggtgggacttaggttgaaccttgaaggtcaatgtattggacaggtcaaacaagatggttgccaattacactgcccccttctggaaacccttagcaaacctgccatgcttgcagtcccttctaaggggtttccttagcataagttgccatgctctgtaccatgtgacctcacaatcctggccacagatagctagatgtggatagtgtctggttcaagggcaaccaatctctaggctggccagtggcctgttagctggactggcataaggacttcaccttacaggggtggcatgtatcaaatggcaaatgtatgaaacaaccagatctttcagggaggcagaatgtgagctattcagaagaagtgaacgttaattagaatttaatgaggcattagtggtggtggatgaggggtggccagaaactaaacagcaaaagcaaagagaaagctgcagaaaccataagtaagcagaggtcatgagacatttgtataatgagatcacggagccacagggtggcagaagccatgaagcagcaaggcaacaatgggctagaagccatgaagcaataggagccacgaggaacagaaaccgtgagacaaaactgactatgagatccacaaagcagcagaaggcttgaatagataagatcatgagacagtagaagcgatgagactgcaagaaccacaaggtagccagaaccatgtggcaacatggcaacaggaatggaagaggcagcaggagctacaatgcagaaaagccatggattaataggaactgaagcgccgggagccatgaagctgcaggacccatgaggcagaaaaagccatgggctagcatcgaggggggcagaaagaagttagtcagtagcagtaggaggagtataaatacagccagaaaggagttgagtcaccaatttgggaagcactagagaagggagcaacagatgcctgcagctgagggggtgacaagataagccaggctctagagctgctttggatcatgaaccattttcaagtttctgttcttccatgaggctgcctgtgtagctgttcttgtcttccttatttccctgtgaatgctttaataaatccccatcactaa

SEQ ID NO: 1184 - DNA, 677 bp, Homo sapiens
gcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccaggggtgctgtggaatctattgccatgaaaccccaaagagaggacagctctatttgaagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaa

SEQ ID NO: 1185 - DNA, 1761 bp, Homo sapiens
agttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggccaagatcaagcaaaagctgcgggaaattgaagagaatcagaagcggattgagaaactggaggaatacatcaccactagcaagcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtgtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaa

SEQ ID NO: 1186 - DNA, 868 bp, Homo sapiens
attggtacactccaactcctttctactcttctctggaggcggcacttttgaatttcagacccagcgctccagtctttagaatgcttgaggtgtcgatccccaccccccaccgctatgtcagaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggaggttcttctgagtacaagatcaacaacaaagtggtccaactacatgagtacagtgaggaattagagaagttgggcattctcatcaaagctcgtaacttcctcgttttccagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaa

SEQ ID NO: 1187 - DNA, 3996 bp, Homo sapiens
gtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaa

SEQ ID NO: 1188 - DNA, 3507 bp, Homo sapiens
ggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcg

SEQ ID NO: 1189 - DNA, 893 bp, Homo sapiens
cggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagg

SEQ ID NO: 1190 - DNA, 1020 bp, Homo sapiens
gtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcggcacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaaga

SEQ ID NO: 1191 - DNA, 3538 bp, Homo sapiens
gcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctg

SEQ ID NO: 1192 - DNA, 4887 bp, Homo sapiens
atataggcggggtctccccgccgcaggggctgggatgctgggggctgctgaagccgccatcttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgttcaa

SEQ ID NO: 1193 - DNA, 3698 bp, Homo sapiens
ggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggaactctagccaagaaccacggcctacactctccaacacaatccagaggccacaactaggtcccacagctaatttacccctggagatgggctcaggacagctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttg

SEQ ID NO: 1194 - DNA, 2542 bp, Homo sapiens
catggcggcgactactgccaaccccgaaatgacatcagatgtaccatcactgggtccagccattgcctctggaaactctggacctggaattcaaggtggaggagccattgtccagagggctattaagcggcgaccaggcaggcttaaagtatttattgttggctttcctcaggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagcctttgacatataggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgt

SEQ ID NO: 1195 - DNA, 3701 bp, Homo sapiens
ggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggaactctagccaagaaccacggcctacactctccaacacaatccagaggccacaactaggtcccacagctaatttacccctggagatgggctcaggacagctggcacccagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaa

SEQ ID NO: 1196 - DNA, 2427 bp, Homo sapiens
actgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagc

SEQ ID NO: 1197 - DNA, 2892 bp, Homo sapiens
cttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgcctgatcttggactcaagattctcctgcctcagaccccgagtagctgggactacagaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtt

SEQ ID NO: 1198 - DNA, 1618 bp, Homo sapiens
cagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaa

SEQ ID NO: 1199 - DNA, 1374 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagtcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 1200 - DNA, 10798 bp, Homo sapiens
ttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 1201 - DNA, 10035 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 1202 - DNA, 10083 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 1203 - DNA, 10083 bp, Homo sapiens; identical to SEQ ID NO: 1202

SEQ ID NO: 1204 - DNA, 1231 bp, Homo sapiens
acgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaa

SEQ ID NO: 1205 - DNA, 886 bp, Homo sapiens
ctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctcccacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagag

SEQ ID NO: 1206 - DNA, 560 bp, Homo sapiens
agcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctgg

SEQ ID NO: 1207 - DNA, 666 bp, Homo sapiens
gggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccag

SEQ ID NO: 1208 - DNA, 395 bp, Homo sapiens
tgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaga

SEQ ID NO: 1209 - DNA, 941 bp, Homo sapiens
gagtccctgcttcgcagagcaccggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 1210 - DNA, 820 bp, Homo sapiens
gagtccctgcttcgcagagcaccggacttggagtcagagagacctggctgcgaatcccggctccgccactttctagcgctgtgaccttggcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggcc

SEQ ID NO: 1211 - DNA, 505 bp, Homo sapiens
cggacttggagtcagagagacctggctgcgaatcccggctccgccactttctagcgctgtgaccttggttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaa

SEQ ID NO: 1212 - DNA, 998 bp, Homo sapiens
gcaccgctgagctgccgagaggaagctcgctctgcccggctgccctcttgtagtccgccggcgaggggcagttctcggtgaggaggaagagagcagcggacggcacagcacccgcgcgggccctccggcaggcggcttctcagagttttcaggtggcgaaactgactggtctggttagagcgcgtccaagccaagccgcagtgctgtttggatttttaaatttctccttctgagtgagaaaatagcaatcgagatggaaccatccgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaa

SEQ ID NO: 1213 - DNA, 1905 bp, Homo sapiens
gtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataa

SEQ ID NO: 1214 - DNA, 645 bp, Homo sapiens
atggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaacccccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttga

SEQ ID NO: 1215 - DNA, 1793 bp, Homo sapiens
gagggcagggtttgcccggaggaagagcgtgaggcgaagctggggaataacaacaggatgtgcaacaacaggatgaggagggctgatttaatgcctgaagactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaa

SEQ ID NO: 1216 - DNA, 1776 bp, Homo sapiens
caaagggggtgtgggctcgggtccccccgcccgatcgcaggggaaggggctgtttgtgcagcgtccggctgtgttatgagtggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaa

SEQ ID NO: 1217 - DNA, 741 bp, Homo sapiens
taatacgactcactatagggaaataagagagaaaagaagagtaagaagaaatataagagccaccatggccgaccacctgatgctcgccgagggctaccgcctggtgcagaggccgccgtccgccgcggccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcgggctgcaccgcgtgcgcgagctgcccgagctcttcctgggccagagcgagttcgactgcttctcggacttggggtccgcgccgcccgccggctccgtgagctgctgataataggctggagcctcggtggccatgcttcttgccccttgggcctccccccagcccctcctccccttcctgcacccgtacccccgtggtctttgaataaagtctgagtgggcggctctaga

SEQ ID NO: 1218 - DNA, 1290 bp, Homo sapiens
ctacaggttgcgggcctttgtgaccccaggctgcggccgcaaggtgcgcagtagtgggctgggccggggcaccagtcgggtttggttttgctccgcccggccgagctgcagggaccgcacggtgcccgggtctcccgccgcagagcagccgctggcccgggccgggggagccggcgctgaccaccgcgcgctgtccccgcaggcagccggcctgccgccatggccgaccacctgatgctcgccgagggctaccgcctggtgcagaggccgccgtccgccgcggccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggcgccaagcgccgcagccccgccgccgcccgcgcacgccctgggcggcatggacgccgaactcatcgacgaggaggcgctgacgtcgctggagctggagctcgggctgcaccgcgtgcgcgagctgcccgagctcttcctgggccagagcgagttcgactgcttctcggacttggggtccgcgccgcccgccggctccgtgagctgctgagggcggccggcgcccgcccggcgtgccggagaggagaaagggcccgactgcccgccggaccctgcacccagcgactgggccccgcgcgcgccctccgcgagggtggaggcggcggctgtgtgcgcagggcccggcaccggactgggaccctggcgtccctccaggccttgcctcctgcgggaggacagtttggcttcacttctctgaccccagcctcggccgtaaagtgaaagagaccggaccagcttcagctttcggactctggttcttggatcgtgtcctctccccctcgccgccctcttcccccaatctgagccattgcaggcctctgcctgctgccccctctctcctcgggatcgggtccccagagccaccatctcctgagcctcccaccccgctgcctgggccctgtggttgctgggcctcccacctcaaggaggggaaggttgtacagcccgaacccgtggagcaatgccctgtctggcctccaaaaccaaaataaaactgggtcacttt

SEQ ID NO: 1219 - DNA, 911 bp, Homo sapiens
tcagctgttgcggggcggggccttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggtgtccatgatccctccccactgaccttttctaagaaaattcttgtgcccgcattggtattaaatcctcgcattcagtcttcctgcctctacttgctcagatttctttttttctagctttcatttagtcttacatttgttccagtgcagaggttctcacccttcagtgtgcataaatgttataaggggtacttgtaaaagcattcacttttttgttgttattattaaattcggagtgttgctctgttgcccaggctggagtgcagtgg

SEQ ID NO: 1220 - DNA, 785 bp, Homo sapiens
acaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctcgggaagttctgcgcatgcgtggcaccatttcctgtgaacacccatgggaggtcatgcctgatctgtacttctacagagatcctgaagagattgaaagagaagagcaggctgctgctgaaaaggcagtgaccaaggaggaatttcagggtgaatggactgctccagctcctgagttcactgttactcagcctgaggttgcagactggtctgaaggtgtacaggtgccctctgtgcctattccctactgaagacgggagcgctcagcctgccacggaagactggtctgcagctcccactgctcaggccactgaatgggtaggagcaaccactgac

SEQ ID NO: 1221 - DNA, 743 bp, Homo sapiens
gtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagaggggtccatacggcgttgttctggattcccatcgtaacttaaagggaaactttcacaatgtccggagcccttgatgtcctgcaaatgaaggaggaggatgtccttaagttccttgcagcaggaactcacttaggtggcaccaatcttgacttccagatggaacagtacatctataaaaggaaaagtgatggcatctatatcataaatctgaagaggacctgggagaagcttctgctggcagctcgtgctattgttgccattgaaaaccctgctgatgtcagtgttatatcctccaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctcgggaagttctgc

SEQ ID NO: 1222 - DNA, 770 bp, Homo sapiens
acaggaatctgaatttctgtgtttggaatttgatgaggtcaaagtcaaccaaattctgaagacgctgtcagaggtagaagaaagtatcagcacactgatcagccagcctaactgaagatgatgtatgaaggagttggagttgttgaaaccaagtcctttccacgctacctgcagaggggtccatacggcgttgttctggattcccatcgtaacttaaagggaaactttcacaatgtccggagcccttgatgtcctgcaaatgaaggaggaggatgtccttaagttccttgcagcaggaactcacttaggtggcaccaatcttgacttccagatggaacagtacatctataaaaggaaaagtgatggcatctatatcataaatctgaagaggacctgggagaagcttctgctggcagctcgtgctattgttgccattgaaaaccctgctgatgtcagtgttatatcctccaggaatactggccagagggccgtgctaaagtttgctgctgccactggagccactccaattgctggccgcttcactcctggaaccttcgctaaccagatccaggcagccttccgggagccacggcttcttgtggttactgaccccagggctgaccaccagcctctcatggaggcatcttatgttaacctacctaccattgcgctgtgtaacacagattctcctctgcactatgtggacattgccatcccatgcaacaacaagggagctcactcagtgggtttgatgtggtggatgctggctc

SEQ ID NO: 1223 - DNA, 805 bp, Homo sapiens
agagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggttcattgcaaccagtgattcacattctccaagcccactttgtatatgtggcgaccggctatccattgaagccatgaaaccttcaaaactgctttgccacatggagaccaagcaccctgcattaaaagacaagcctttggagtttttcaaaagaagaaaatgtgaatacaaagaacagaagcaattattgaaggccaccacttcaaatgtgtctgcattgagagcatcattcttagtagctaaccacattgctaaagctaagaagccctttactattggtaagagttgatcctaaggacatttgttttgaaccttcaggagaggacacagttcagaag

SEQ ID NO: 1224 - DNA, 1172 bp, Homo sapiens
agaccactcctcccggcgccgggctcagcccgccttcgccttccctctccccgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaa

SEQ ID NO: 1225 - DNA, 7588 bp, Homo sapiens
gcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 1226 - DNA, 1832 bp, Homo sapiens
gcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctg

SEQ ID NO: 1227 - DNA, 1629 bp, Homo sapiens
gaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcacctt

SEQ ID NO: 1228 - DNA, 2005 bp, Homo sapiens
agaccactcctcccggcgccgggctcagcccgccttcgccttccctctccccgcggaaccccttctcgtcgcccgaagaaacccgaaggtcttcggcaagttccgtccccagcgcgggggcggggccgctcgagctgctccgggcctagctcggctgtttccgtgcgcggccgctgcgcactcggcactgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaact

SEQ ID NO: 1229 - DNA, 7650 bp, Homo sapiens
tgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 1230 - DNA, 651 bp, Homo sapiens
actgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtata

SEQ ID NO: 1231 - DNA, 518 bp, Homo sapiens
gaaagcagtgacggaggagcttgtaccaccggaactgttggggacacagtgactaaggcaaaatatgtgtcaaaagaaagcagtcaaaggaaaaagggatcacctttggtgaagtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggcctt

SEQ ID NO: 1232 - DNA, 1056 bp, Homo sapiens
agaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatggtaacatgtttagtatataaatcttttccactcaaaccatacattttaattgatattaataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttag

SEQ ID NO: 1233 - DNA, 1029 bp, Homo sapiens
atacatcatacagtaacacacttatgtgcaccattggtgctgagctgctggttatcccactctgccatgtgtgctgtttctctttgcttttgccactactccactctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatacatacctgagggatacaacatactcctgtcagtaacagattcactgttacagagattctcacttgaactaggaagcatgctctttaggaaagaggcctatcagaatctaaaaaggggaaatgaagttgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatgagtctacttgaaattttttaatatgaatttaccaatatcaaaggaagacactgaggactatactctatctaggaagatcatccaagctgtg

SEQ ID NO: 1234 - DNA, 1097 bp, Homo sapiens
gagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgaggcggcgtgtagcgcacactttctggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctgg

SEQ ID NO: 1235 - DNA, 11523 bp, Homo sapiens
aggcacaggcagcctgcatacactccttttcctggtgtcaacattatttaaaagcatgggaaatagtaatgagacagtgtcttcttcattagaaccttaggagtctactagatttcttcatctctatttgttgttattagtagccaaactgtgcaaaaaacacggtcttgagaaatgacagcacagtatcttagagggaaaggaaatgtaggatgccagtgtggggacaaatttctgattgccagtgattgttgtgagcataacaataatttcatgaacattaaagcctctattgagggcagctgcagttgtaaaggaaaaaaaatggtcctgaacatttaaaactacactggtgtacatcataatcaaacaaagtaaacagaaaaaaatttaaactttgctaaaaaaaaaaagcagaagcacttgatctttaggaaggcacgcagttgcttattatgaatcatttctagagtccgatgcattttcaaagccggttacagtcattacgaagcacacccttgtgaggtaagtgtatcatcacctttggttcataaataaaaaagctgagacgccgagcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaaaaaaaaaaaaaaaaaggtgggggagagactccacttcccagaagcctctcgttactcacgcagccgcagtcttgcgcaggtgccgccagggccaaacggacatatccgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtagcatttgattattggtattaccattttagaatcatgatgttattttaaacctttttcctggggacaagaaaggataataaattacgctgaatcacttttggcagttgccacttaaatagtacagtgacttgcaacttttataactttatcagcatcttctctaaatacaaaattaggctatatgttattttccaacttactgttttctctctgtttagcaggatattataaatagattaaatagatatattttctttttttttttttttttttgagacggagtctcgctttgtctcccaggctggagtgcagtggcgtgatctcccagtagctgggactacaagcacctgccaccatgcccggctaattttttttgtatttttagtagagacggggtttcactgtgttagccaagatggtctcaatctcctgactttgtgatctgcctgcttctgcctcccaaagtgctgggattacaggtgtgagccaccgtacccagcccaaatagatgtattttcataatagagaattgaaataggctttaatgggtgaatagcagtttattgtaggcatgtgacatttcatttaatgaatttaaagtttattatcccaattctacagaaggatttaatgcatactatgcaattaaataattataacactacatagtaataatttatgtgccaggcagtagttcagtcactttacatgcttattaacctgcagaataatcttttgagatgtaggtgctgttactgagaatttaacttttgcttgtaaattgcaaagggtggatttgaattctggaaatttggttccagagacaataattacataacactttctccatagggtacagcctgtctaataggctatagtaaatcacctcagcttgttataggtcgggcatgcaaacatttctccattttactccctttggtaatgaatctagtaatagatggaaattttccctagattcactgtgttagtcagttggggaagtttggaggcaaagatacaggagtttatggggaggtagtgtacataaatataatcatatgctatataaggaagttttggtcagcagcagaccatatataggatggtgggccagtaacattgtaacactgtatttttactgtatcttttccatgttttgttatgtttagatacacaaataacattatggagtattcagtatggtaacatgccatacaggtttgtagcctaggagcagtaatagactgttccctgaaacctatatttgtggtaggtttataccattcaggtttgtgtaagtacacaacgaaatcatctaatggcccatttctcaaaacatattcccatcattaatcaatgcatggtcatgttttcgtatacattttaagcttctgtattctaatctaatataaatggcaaaatattcaaactgataggcattgagattcttaaatgctaaagttgcattcaaaaggataattttaggcgttgtgacaaagcagtgttatattttaaagttagtgacaaggctatgcaccttttatctctaattgtttcttacagaatgtttttattattgagtagtaaaacaataaatgtcagatcctttatacaaattcaagattgacattgataaacaaaacttcagcatatcactcaaggtcagcgtagaaattgtgtgtctggaaacttctatagtaattttatattactgtgacattagtatgtgatcacttttctagtaatgttttaaaaaaatatatcttacaggccaggcatagtgctttatgcctgtaatcccagcactttgggaggccaaggtggcaggattgcatgagtccaggagttcaacaccagtctgggcaataaagtgagaccccatcgctacaaacaaattaaaaaatatttatgtatgtgtgtaatatatataatatataacaaaacacatatgtatgtgtatatatagtatgtctggcagagtacaatttaggggttaagactggtccctcacatatggtgtgagaaacactgttcacaggttgctttccccattagcccagggcaactcatttgcccatcatttcctagaacaaccgggtctgttacgtctacagttttcatcttcatgcagttatggatttggtgtcaaaaactttggtcctgttctctaccatcttaaaataaactcttgtgtcctgctttactatgaattgcaaagtaggcattaggtagccttcctactaccatagtttagagttcaatattcttatgaccattctactggtagaagcaaaaaatgaacttgtaggcatgtgatcacatgtgcctatggtgctgtcttttccagtacaggggaactaattttcatattttaatcttgcagctttttgtttacttcatgcattgtgatttctcatagttttgcacagaactcacttccctaccttttctgaaacaaaagtatgtatacacacatacatatgtattgagcacctctatttactgtgttccacgtgctgggcatatagcaagaacagaatggtctggggccctgctctaaagaagatttaaaagcaaacatatattaaaaatgcgtgagtctggccaggagcagtggctcatgcctgcaaccccagcactttgggaggctgaagcgggtgaatcacctgagatcaggagttgagaccagcctggccaacatggtgaaaccccgtctctactaaaaatacaaaaattagcctggcatggtggcatgcgcctgtaattccagctactttggagactgagacaggagaatcacttgagcccaggaagtggaggttgcagtgagctgagatcgcgccactgcactccagcctgggtgacagagcaagactccatctcaaaaaaaaaaaaaaaacgtgtctgttcataaggttctacaaatagctgttgttacagaaaataggactagggttttattactggggattatgcagtcgaggtaaatataaaatgaggttgtttcttcttttttttatttgagacagagtcttgtttgccaggctggagtgcagtggcgtgctcttagctccgcctcccgggatcaaacgattctcttgcctcagcctctcgagtagctgggactacaggcgcgtgccaccacacccagctgatttttgtatttttagtagagatgggatttcaccatgatggccaggatggtctcgatcttttgacctcatgatccacccacctcggcctcccaaagtgctgggattacaggcgtgagccactgcacccggccctggttctaaatactcttccagctctaaaacattgattctaaacagatcacattccaggaggactctagcaaaccagcatatgcaaattatagcttttgcaagaccgtttctacttttatattactgaactctatatgattgtccaagtaaagttttgtgtctctttgattatttgattgtactttaaaattttttcaccattcatttaacattttttaccatactgtagtatttttaatgcaattgtgtttgcattggtgtggctttagaggcttctccaaccaccttcccaaaatactgatctgtgatttttttctttaatgtttggccaaacataatacatgcttattttatttttcatccctacagaaaggtagaagatgagaattctgtctcctactgttgtttttcaaggtgccactcaaatttcttgtacgtgtctagaaacttgtgcatacaatagaagtacactgtggctgggcatggtggctcatgcctgtaatcccagcactttgtgaagctgaggtgggtggatcacctgaggtcagggagtttgagaccagcctggccaacatgatgaaaccccgtctttactaaaattagaaaaaattagccaggcgtggtggtgtgcgcctgtaatcccagctactcgggaggctgaggcatgagaatcacttgaactcgggtggcagaggctgcagtgagctgagatcatgccactgcattccagcctgcgcagctgagccagactccatctccaaaaaaaaaaaaaaaaaaaaaaaaagatgtccaatatatgtaacttttttctttggacacaaaaattccattagctttgttttctcatttttacttgtcatgatgtatgtcgaacacattatttttagtgtctggtgttccattatacagatgtctctcttgttggttgaatttttgcattcacagaccctcaagttggattcatatctttttacactaagcataaagaagacggattggggtcgggtatggtggctcacgcctgtaatcccagcacttcgggaggctgaggtgggcggatcacgaggtcaggagttcgagaccagcctggccaacatactgaaaccccgtctctaaaaatatgaaaaaaaaattagccaggcgtggtggtgcgcagctgtagccccagctacttgggaggctgaggcaggagaatcacttgaacccaggaggtggaggttgcagtgagcatattgcaccattgcattccagcctgcacgacagaggaagacgccatttcaaaaaaaaaaaaaaaaagacggattgattttcttcagcagtatcaagtggcacttaccatccacccctttaacacccaaaccattctaatccatgtatacagaccatcatctgtttcgttattgtgttctataatgcagctttgcgagttatgcagttttggtcctcatgatatttttctgattggtttttaatgtattttgttctaacgagccaacattgttatacatgtaatttgtttatttgctagattgtactctttcccaaagatgggctatgaactagcatctactttcattttacctatttacctgtaaacattgaaaaaactgaatcaaatgcagtgatatcggacctagttttattgttatgccttataatgaatttaacttcacagttttctaaatgagagcatttcccaaagacatctttatggtcataaccagtttcccttggcatttgatttatttttatttttatttatttatctttttgagaaggagtttcgctcttgttgcccaggctagagtgcaatggcgtgatctcgggtcactgcaacctctgcctcccgggttcaagcgattctcctgcctcagcctccaagtagctgggattacaggcatgcaccaccacgcccgactaatttgtatttttagagacggggtttctccgtgttggtcaggctggtctcaaacttccaacctcaggtgatccgcccgccgtggcctcccaaagtgttgggattacaggcgtgagccacagtgtctggcctgatttgtttttaagagcattatttttctgctttattttgtgacttcaacatttgacacaattttgggtgaatggtttgtgcatggtgcctgacatcgtgttttgatgtgtagtatatgccataggacatgtgagacaagatatgtcccaacttgaccttgttttgtattgtttatgtcaaggtgttgagtgtattagatatactgttggggctctgtgttctagctctgccttttagataataaccatggttaaatattgcaatgtcctgcatgtctccacacatgggttttgtaactgagtcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgtccatgtgttctcatcatttagctcccacttacaagtgagaatgtggtgtttggttttctgttcctgcattagtttgctaaggataatggcctcgagctccatccaagtccctgtaaaggacatgatcttgtacttttttatggctgcatagtattctgtggtgtatatgtaccacattttctttatccagtctatcattaggcatttaggttgattccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttcttacaaactcctaacaccatttacgactttgtcatcaatatggtcaactaagcttggtttgcatggctctacttcctttcaccttccacttaggcagtgtctccaagtccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgta

SEQ ID NO: 1236 - DNA, 2101 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 1237 - DNA, 2101 bp, Homo sapiens
cgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 1238 - DNA, 3019 bp, Homo sapiens
atggtttccgttgggtgtgtggtttttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctgggaaatgtga

SEQ ID NO: 1239 - DNA, 2551 bp, Homo sapiens
agataagtcagggaggggacagagcggccctaggcgcgccacagagaggagcgaggcgccagaggcaccatggactggcaagaccacaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 1240 - DNA, 5908 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatgatgaattgcctggggtctgtaagaatgtgggactctgatcttccccctcttcaggtgtcagtgcggagaggctctgggccagacctcacccccagtgacttccgattgaggccaaagaccccaagctgcccgccagctctgactgccccttgcgctctgggcttcctgccgcccccagctttgcctggacactgacttcattcatggtcctcctacttcaggggcagcctcccagttcctctgcttccaaactatgcaacctccaacctgctccagttccagactgtataacctctgacctgcactggttctagaccacacaacctccaatgtggtctgctttagatcaccttcttcttcttccttcttcctcttcctcttcctcctgctcctcttcctcttcttcttcttttttttttttgacagagtcttgctctgtcacccaggctggagtgcagtggcgcgatttcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctctttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctaaacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 1241 - DNA, 2519 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctccttctctcaggatttctcttggggttctcaatacttggttacctcattatccctttctctgcctctcttggctttattttggggaatcaggggtgaggagggttgggggggtcatatctgtgtttccaggttctggggagaacaatgatccacgggtcaacgtgatcacatttccttctatccttcttgtattattatttttatttttgtcaatttcatgatatggtttttaatcatga

SEQ ID NO: 1242 - DNA, 2462 bp, Homo sapiens
ggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacacctgtatgtatcccatttccccaggtgcgaagccagctgccacatggcccccagctgacaccaggaccccccagctccccataccccaggatgcactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgtgtgtgtgtgtgcgtatgagcatgcatgtgtatcatgcataagtgtatgtgagggagtgtgcacgtgtacacatatgaggaatgtgtgtcaccatgtaaatgccggtgtgtgtgtctgcatggacacaggtatgtgtatgggtgtgtagactgttaatttttttttttttttttttttttttttttgcgtgaacctctgcttaagtggattgttaattcaaattagaaaggggtctttatttggcctggcatggtggctcatgcctgtaatcctagcactttgggaggctgaggtgggcggattgcctgagctcaggagttcgaaaccagcctgggcaacatgacgaaatgctgtttctactaataataccaaaaattagccgggtgtggtgacacatgcctgtaatcccaactactcgggaggctgaggcacgagaatcattagaacccaggtggtggaggctgcagtgagccgagattgcgtcagtgcactctggcctcggcaacagagcgagactctgtctcaaacaaacaaacaaacaaacaaacaaaaggactctatattcaagttaaaataagaagtgtaacagaatcatggggtcttttttgctttttaaattttgatgtggctcacacctgtaaatcccaaagtgttgggattacaggcatgagccactgcacccggcccatgttgtggtttatatcagtagttcctttgtaaatagtgaacagtattccatggtatgaatagagcacaggttttttttttatccattcaccagttagaagacattgggctgtttccaagtttgggtgattacaaaaaaacagctactgtaaacattctcatacaagattttatgagatcacatgttttcatttctcttgggtaaacagctaggattggaatggatgggttatatagtaagtgtatatttaatctaagaaactgccatggctgggcacagtggctcacgcctgtaatcccagcactttgggaagccaaggaaggaggatgactagagcctctgaggtgaagaccagcctgggcaaagtggttaagactcaaccgcaaaaaaagaaaaacagaaaacctgaaaacaaacc

SEQ ID NO: 1243 - DNA, 2101 bp, Homo sapiens
cttttctctttcccgagtcaccaccagtgaatgctgcccatgccctcaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 1244 - DNA, 1462 bp, Homo sapiens
atggtttccgttgggtgtgtggtttttttgttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataagggggctcccacccctaagagaattgaatatcctctcaaagctcatcagaaagtggccataatgagaaacattgagaagatgcttggagaggccttggggaacccacaagaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtc

SEQ ID NO: 1245 - DNA, 1708 bp, Homo sapiens
actcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtccgatgacctgatcggctgttccgcctacgagtacatccacgcgctggactccgatgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatg

SEQ ID NO: 1246 - DNA, 804 bp, Homo sapiens
gagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcgctttgttcctgtgtcctctgctgctacttccctctgcctaccctctctctcacccagtaaagtggctggctatagtcccgatgacctgatcggctgttccgcctacgagtacatccacgcgctggactccgatgcgccccaggatgcactgcctccccacctcaacaccagctccctgctccccaagccccaaggaactgtctccttccttgccccctcatacccagtccccagatatttctctccccatttgcccccttggtggccctga

SEQ ID NO: 1247 - DNA, 1367 bp, Homo sapiens
ccgagggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacactcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgatgcggtcagcaagagcatccacacctgtatgtatcccatttccccaggtgcgaagccagctgccacatggcccccagctgacaccaggaccccccagctccccataccccaggatgcactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgtgtgtgggcctgatctgcatgtgtggacaggtgtgtgtgtgtgt

SEQ ID NO: 1248 - DNA, 1044 bp, Homo sapiens
aaatgaaactcgacgctctggatagagccaaggaaggctcctgctattcgggggtcctcgagggagccattaaaacctcggcttcctcatttgaggaaacagcctgagccaaggagaaaattgaagtcctctcagctgcagctgctcacccacccccctcccacctccctccacagagaaaagcacccactccattgactctgaggggtcacgagaaggttcgggaaaaagggtcacagtcaagccacccaacccagccggccttctcccatcactacttgggtgcgagcataccctctctgtctcaccccatgccatcatccgggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtggactttgacaatcccgactacgagaggttccctaatttccaaaatgtggttggttacgaaacagtggttggccctggtgatgttctttacatcccaatgtactggtggcatcacatagagtcattactaaatggggggattaccatcactgtgaacttctggtataaggg

SEQ ID NO: 1249 - DNA, 3181 bp, Homo sapiens; identical to SEQ ID NO: 532

SEQ ID NO: 1250 - DNA, 3248 bp, Homo sapiens; identical to SEQ ID NO: 533

SEQ ID NO: 1251 - DNA, 3729 bp, Homo sapiens; identical to SEQ ID NO: 534

SEQ ID NO: 1252 - DNA, 3182 bp, Homo sapiens; identical to SEQ ID NO: 535

SEQ ID NO: 1253 - DNA, 3235 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaa

SEQ ID NO: 1254 - DNA, 1470 bp, Homo sapiens
cactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 1255 - DNA, 3329 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgttttgttgccgctgcgtctcgccagattgaggcatcccctccgacatcactggagcatatctggaggggtggacagttctccacagggagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 1256 - DNA, 3209 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 1257 - DNA, 1603 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatga

SEQ ID NO: 1258 - DNA, 1339 bp, Homo sapiens
ggccatggtcagcgtgaacgcgcccctcggggctccagtggagagttcttacgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagcc

SEQ ID NO: 1259 - DNA, 4737 bp, Homo sapiens
ggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaaaaaaaaaaaaaaaaa

SEQ ID NO: 1260 - DNA, 2508 bp, Homo sapiens
ccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 1261 - DNA, 1050 bp, Homo sapiens
gcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttatttt

SEQ ID NO: 1262 - DNA, 2208 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 1263 - DNA, 810 bp, Homo sapiens
gtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtct

SEQ ID NO: 1264 - DNA, 894 bp, Homo sapiens
tggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatt

SEQ ID NO: 1265 - DNA, 792 bp, Homo sapiens
atgcagcgggcgcgacccacgctctgggccgcttgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtag

SEQ ID NO: 1266 - DNA, 2327 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcggcatctacaccgagcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 1267 - DNA, 2193 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggacggccgcgggctctgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 1268 - DNA, 2406 bp, Homo sapiens
atgcagcgggcgcgacccacgctctgggccgctgcgctgactctgctggtgctgctccgcgggccgccggtggcgcgggctggcgcgagctcggcgggcttgggtcccgtggtgcgccgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaagggg

SEQ ID NO: 1269 - DNA, 1480 bp, Homo sapiens
ctcccataccctataactttgtttgttctatttcacacatataattttccgagacaagatgttctcatttaagcaacaagaagattcgtctctcgctattactgtaactgctgtttatatcgtcatgtcccggaaaggtccctgtcttccctgaatggtctctaccaacttcacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggatcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaataaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgaaa

SEQ ID NO: 1270 - DNA, 2631 bp, Homo sapiens
tctctgatcgggcccaccccctggatctagcaccgcctcttccgcgttctcggaggagcgatctgcaggtaggggtgcgcgcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 1271 - DNA, 2421 bp, Homo sapiens
cagaaacaactctccaagttccatttccaaggaaagtcttaaccatttgtcccttctggcgtaccctctttcattgaaatccatgcagaatataccagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 1272 - DNA, 2618 bp, Homo sapiens
gcgatctgcaggtaggggtgcgcgcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattct

SEQ ID NO: 1273 - DNA, 2719 bp, Homo sapiens
gcgaccgctccccggcgggagccagcgaaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaagacaaagtctctctctgtcacctaggctggagtgctatggcgccatcagggctcactgcagccccaacctccctgggctccagtgatcctcccacctcagcctcccaagtagctgggactacaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcaggggcaagctccagaaaagggactccccacgccgcaagtcctccagaggaacagcagcacaatggacctgacgctcttcgcagctgaggccatcgcccttaaccgccagctatctcagcacgaagagaacgaactagcagaggagccagaggcactagctgatggcctctgctccatgaagctttcccctccctgcaagtcacgcctggcccggagacgggccctggcccaggcaggccgtggtgaagacaggagcccgcccacagcactctgaaatgctccagtcacaccttataggccctaggcctggccaggcattgtcccctggaaacctgtgtggctaaagtctgctgagcaggcagcagcctctgctctgtggctccattcaggctttttcatctacgaaggccctgaggttcccatcaacccccatttccctagggtcctggaggaaaaagctttttccaaaggggttgtctttgaaaaggaaagcaatcacttctcactttgcataattgcctgcagcaggaacatctcttcactgggctccacctgctcacccgcctgcagatctgggatccagcctgctctcaccgctgtagctgtggcggctggggctgcagcctgcagggagaagcaagaagcatcagttgacagaggctgccgacacgtgcctcttccctctcttctctgtcaccctcctctggcggtccttccaccttcctctgtcctccggatgtcctctttgcccgtcttctcccttggctgagcaaagccatcccctcaattcagggaagggcaaggagccttcctcattcaggaaatcaaatcagtcttccggtctgcagcacggaaaagcacataatctttctttgctgtgactgaaatgtatccctcgtttatcatcccctttgtttgtgattgctgctaaagtcagtagtatcgtttttttaaaaaaaaagtttggtgtttttaaccatgctgttccagcaaagatgataccttaaactcccactgcaagcccatgaacttcccagagagtggaacggcttgctcttctttctagaatgtccatgcacttgggttttaatcagcagttccctattattctgattttaagctgttcctgtgatgaacttagagacagcatcggtgtctgctgctgtgtccccaggtcttgtgtgggtggcacagatctgggcagttagatagtgctctgtgcctaaggtgaagccacactagggtgaagcctcacttccctgtttgagcaatgcagtgcctgctgcccgtgtgcatgaaggtacagccattcagataagtggaactattgagttacataaagaaaatagatttgcatttgtcaggcagacgtttatacaacaccacggtgcttttatacattgtgcttattttaataaaactgaaattcta

SEQ ID NO: 1274 - DNA, 1270 bp, Homo sapiens
ttccgcgttctcggaggagcgatctgcaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtgaatctccagaaaaggtgtctccagtgaaaatctgtgactttgacttgggcagtgggatgaaactgaacaactcctgtacccccataaccacaccagagctgaccaccccatgtggctctgcagaatacatggcccctgaggtagtggaggtcttcacggaccaggccacattctacgacaagcgctgtgacctgtggagcctgggcgtggtcctctacatcatgctgagtggctacccacccttcgtgggtcactgcggggccgactgtggctgggaccggggcgaggtctgcagggtgtgccagaacaagctgtttgaaagcatccaggaaggcaagtatgagtttcctgacaaggactgggcacacatctccagtgaagccaaagacctcatctccaagctcctggtgcgagatgcaaagcagagacttagcgccgcccaagttctgcagcacccatgggtgcagggggaacagcagcacaatggacctgacgctcttcgcagctgaggccatcgcccttaaccgccagctatctcagcacgaagagaacgaactagcagaggagccaga

SEQ ID NO: 1275 - DNA, 738 bp, Homo sapiens
tctctgatcgggcccaccccctggatctagcaccgcctcttccgcgttctcggaggagcgatctgcaggtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggttccatcttagcccacatccagaagcaaaagcacttcaatgagcgagaagccagccgagtggtgcgggacgttgctgctgcccttgacttcctgcataccaaaggcattgctcatcgtgatctgaaaccagaaaatatattgtgtga

SEQ ID NO: 1276 - DNA, 1127 bp, Homo sapiens
gcaggagggcagccgcggccggcaggacaggcagacggacaggctgacaggagagagaacaggcactgcgggacctgcaggagaaaggcgatcctgtggctgggaatgtgaccccacggccagaagaggacccgtttccatgtcagaggccaatggagaactgaagattgccacctacgcacaaaggccattgagacacttcgtgtagctggaagacaccaacttcctgacaggagctttatttcatttgggatttcaagtttacagatggtatcttctcaaaagttggaaaaacctatagagatgggcagtagcgaaccccttcccatcgcagatggtgacaggaggaggaagaagaagcggaggggccgggccactgactccttgccaggaaagtttgaagatatgtacaagctgacctctgaattgcttggagagggagcctatgccaaagttcaaggtgccgtgagcctacagaatggcaaagagtatgccgtcaaaatcatcgagaaacaagcagggcacagtcggagtagggtgtttcgagaggtggagacgctgtatcagtgtcagggaaacaagaacattttggagctgattgagttctttgaagatgacacaaggttttacttggtctttgagaaattgcaaggaggtacttaccgttgagtatgtgtgtggacttctgattaagacccagggtggtgatcatccatcatgaatcccagagacttccaaaacgagtcaagctaataaaaaggatgaaggacttaaaaactgcccttgatttgggagaagggaggccggagggaaggatgataattagcattttgcagagcttagaatgtcacctgtgtgggtattttataaatgccttttcattataataggagtcatatatagatacatttagtcatcgatttatcaatcccgttttgacatgttcactgtttaactacattaattatggggtggaagctctcaaatacattgcgaagtctagaaaggctaaaacagaggagaggagggtcctattgtttgggacacagacccaggataaaggggaagcctgagaatgtgccatccttcagatggaaagatgccatcacccacacacataatcactg

SEQ ID NO: 1277 - DNA, 3774 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtc

SEQ ID NO: 1278 - DNA, 1747 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtc

SEQ ID NO: 1279 - DNA, 1503 bp, Homo sapiens
agatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttat

SEQ ID NO: 1280 - DNA, 1425 bp, Homo sapiens
aggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattccca

SEQ ID NO: 1281 - DNA, 3829 bp, Homo sapiens
gtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacctgatattaagggaaactaaagaaaatgttattgtggatcccacagtactatattacactgttttttttgtttgttttgttagttttttttatttaaagcaaacctcaaacattattgggtatcaattaccacctggttgtattgaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataaca

SEQ ID NO: 1282 - DNA, 859 bp, Homo sapiens
ccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctagatcgccgatgtagatttgtacaggagtctccgttggccggaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactga

SEQ ID NO: 1283 - DNA, 9585 bp, Homo sapiens
cttgtttgtgtgctaggctgggggggagagagggcgagagagagcgggcgagagtgggcaagcaggacgccgggctgagtgctaactgcgggagccagagagtgcggaggggagtcgggtcggagagaggcggcaggggccgagacagtggcagggggcccggggcgcacgggctgaggcgacccccagccccctcccgtccgcacacacccccaccgcggtccagcagccgggccggcgtcgacgcctaggggggaccattacataaccccgcgccccgcggcgtcttctcccgccgccgcgggcggccccgaacggagccccggggggcgggcgctcccagcacctggccgccggcggtgggggccgtagcagcggccgtatttatttattttccgcgggaaaggaaggcgaaggaggggagcgcggcgcgaggaggggccgcctgcgccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagaca

SEQ ID NO: 1284 - DNA, 4688 bp, Homo sapiens
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaat

SEQ ID NO: 1285 - DNA, 2981 bp, Homo sapiens
agtgtaatgctagaagtcctagaagaaatttggagtgtgcgtgcgcgccgagcgcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgt

SEQ ID NO: 1286 - DNA, 863 bp, Homo sapiens
aagatgaaggtaggtgatggtggcgagtgttagactgggtttggggaacgtgaatcgagtcccagaacgcggcattgcctcagttccagcactccaggatcctggctttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagatttttt

SEQ ID NO: 1287 - DNA, 892 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaa

SEQ ID NO: 1288 - DNA, 1355 bp, Homo sapiens
gctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaat

SEQ ID NO: 1289 - DNA, 1387 bp, Homo sapiens
gctaagcggaagttggccctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcagtgaaaaa

SEQ ID NO: 1290 - DNA, 1635 bp, Homo sapiens
taatacgactcactatagggaaataagagagaaaagaagagtaagaagaaatataagagccaccatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgataataggctggagcctcggtggccatgcttcttgccccttgggcctccccccagcccctcctccccttcctgcacccgtacccccgtggtctttgaataaagtctgagtgggcggctctaga

SEQ ID NO: 1291 - DNA, 3837 bp, Homo sapiens
cccccgcccccctccgggctggaccgcggatggtacgttccgcacgtgagctgggtgctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacagcttttttttgtcattggcttgatgtcacacatttccaatctcttgcaagcctccaggctctggctttgtctacctgctcgttcccaatgtatcttaatgaaaagtgcaaaagaaaaacctaccaattaa

SEQ ID NO: 1292 - DNA, 1673 bp, Homo sapiens
actgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctc

SEQ ID NO: 1293 - DNA, 6952 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 1294 - DNA, 6895 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 1295 - DNA, 6828 bp, Homo sapiens
ggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 1296 - DNA, 7405 bp, Homo sapiens
gaatctcgcctgccgggaccgcgaaatgggggcgaccgcggcgtccctctccgtcggcgcagccctcgacggcgcttgggtttgaccccggcgcgcttgctcgccccttctcccgagaaggggtttcggaggagcagaggtttaataggcaagagaaagagaaaggaaaacagctctctctctaatgagagagaggggacttcggagaggaaaagaggacaggagatacggcaatcgtggataggaaaggaggaaattacgatagaaaagttggagatccttttgctaacacccctttgggcagttggatgctgagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 1297 - DNA, 7289 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 1298 - DNA, 4597 bp, Homo sapiens
caacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactc

SEQ ID NO: 1299 - DNA, 6156 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 1300 - DNA, 5532 bp, Homo sapiens
ctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgca

SEQ ID NO: 1301 - DNA, 5502 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgc

SEQ ID NO: 1302 - DNA, 5236 bp, Homo sapiens
aggggggtgcgcctttctccgcgtcggggcggcccggagcgcggtggcgcggcgcggggaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagag

SEQ ID NO: 1303 - DNA, 5424 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggc

SEQ ID NO: 1304 - DNA, 5322 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgc

SEQ ID NO: 1305 - DNA, 972 bp, Homo sapiens
taatacgactcactatagggaaataagagagaaaagaagagtaagaagaaatataagagccaccatggaaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggagtgatttgggccccgatgttggctatgaagctattggtcttgtggacagtagtttgcccacagttggtgtttttgcaaaagcaactgcacaagacaaccccaaatctgccacagagcagtcaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaagatcattaaggacggtgagcagcatgaagatctcaatgaagtagccaaactattcaacattcatgaagactgataataggctggagcctcggtggccatgcttcttgccccttgggcctccccccagcccctcctccccttcctgcacccgtacccccgtggtctttgaataaagtctgagtgggcggctctaga

SEQ ID NO: 1306 - DNA, 1683 bp, Homo sapiens
taatacgactcactatagggaaataagagagaaaagaagagtaagaagaaatataagagccaccatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgataataggctggagcctcggtggccatgcttcttgccccttgggcctccccccagcccctcctccccttcctgcacccgtacccccgtggtctttgaataaagtctgagtgggcggctctaga

SEQ ID NO: 1307 - DNA, 1377 bp, Homo sapiens
taatacgactcactatagggaaataagagagaaaagaagagtaagaagaaatataagagccaccatggtggccgggacccgctgtcttctagcgttgctgcttccccaggtcctcctgggcggcgcggctggcctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctgataataggctggagcctcggtggccatgcttcttgccccttgggcctccccccagcccctcctccccttcctgcacccgtacccccgtggtctttgaataaagtctgagtgggcggctctaga

SEQ ID NO: 1308 - DNA, 1534 bp, Homo sapiens
tcaagcttttggaccctcgtacagaagctaatacgactcactatagggaaataagagagaaaagaagagtaagaagaaatataagagccaccatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtgataataggctggagcctcggtggccatgcttcttgccccttgggcctccccccagcccctcctccccttcctgcacccgtacccccgtggtctttgaataaagtctgagtgggcggctctaga

SEQ ID NO: 1309 - DNA, 759 bp, Homo sapiens
taatacgactcactatagggaaataagagagaaaagaagagtaagaagaaatataagagccaccatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggcctgagctggagagttgatggcaagtctcagtcaaggcactcagctcaaatacacacacctgttgccattatagagctggaattaggcaaatatggacaggaatctgaatttctgtgtttggaatttgatgaggtcaaagtcaaccaaattctgaagacgctgtcagaggtagaagaaagtatcagcacactgatcagccagcctaactgataataggctggagcctcggtggccatgcttcttgccccttgggcctccccccagcccctcctccccttcctgcacccgtacccccgtggtctttgaataaagtctgagtgggcggctctaga

SEQ ID NO: 1310 - DNA, 1665 bp, Homo sapiens
taatacgactcactatagggaaataagagagaaaagaagagtaagaagaaatataagagccaccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgataataggctggagcctcggtggccatgcttcttgccccttgggcctccccccagcccctcctccccttcctgcacccgtacccccgtggtctttgaataaagtctgagtgggcggctctaga

SEQ ID NO: 1311 - DNA, 624 bp, Homo sapiens
taatacgactcactatagggaaataagagagaaaagaagagtaagaagaaatataagagccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgataataggctggagcctcggtggccatgcttcttgccccttgggcctccccccagcccctcctccccttcctgcacccgtacccccgtggtctttgaataaagtctgagtgggcggctctaga

SEQ ID NO: 1312 - DNA, 2667 bp, Homo sapiens
taatacgactcactatagggaaataagagagaaaagaagagtaagaagaaatataagagccaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgataataggctggagcctcggtggccatgcttcttgccccttgggcctccccccagcccctcctccccttcctgcacccgtacccccgtggtctttgaataaagtctgagtgggcggctctaga

SEQ ID NO: 1313 - DNA, 675 bp, Homo sapiens
taatacgactcactatagggaaataagagagaaaagaagagtaagaagaaatataagagccaccatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgataataggctggagcctcggtggccatgcttcttgccccttgggcctccccccagcccctcctccccttcctgcacccgtacccccgtggtctttgaataaagtctgagtgggcggctctaga

SEQ ID NO: 1314 - DNA, 771 bp, Homo sapiens
taatacgactcactatagggaaataagagagaaaagaagagtaagaagaaatataagagccaccatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttgataataggctggagcctcggtggccatgcttcttgccccttgggcctccccccagcccctcctccccttcctgcacccgtacccccgtggtctttgaataaagtctgagtgggcggctctaga

SEQ ID NO: 1315 - DNA, 1584 bp, Homo sapiens
taatacgactcactatagggaaataagagagaaaagaagagtaagaagaaatataagagccaccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggttctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgataataggctggagcctcggtggccatgcttcttgccccttgggcctccccccagcccctcctccccttcctgcacccgtacccccgtggtctttgaataaagtctgagtgggcggctctaga

SEQ ID NO: 1316 - DNA, 1506 bp, Homo sapiens
taatacgactcactatagggaaataagagagaaaagaagagtaagaagaaatataagagccaccatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagagactcaaaagctcatttctgaaattgacttgttgcggaaacaaaatgaacagttgaaacacaaacttgaacagctacggaactcttgtgcgtgataataggctggagcctcggtggccatgcttcttgccccttgggcctccccccagcccctcctccccttcctgcacccgtacccccgtggtctttgaataaagtctgagtgggcggctctaga

SEQ ID NO: 1317 - DNA, 1059 bp, Homo sapiens
taatacgactcactatagggaaataagagagaaaagaagagtaagaagaaatataagagccaccatgattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcacgatgaagttgatgggggatcccccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataagagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagactgataataggctggagcctcggtggccatgcttcttgccccttgggcctccccccagcccctcctccccttcctgcacccgtacccccgtggtctttgaataaagtctgagtgggcggctctaga

SEQ ID NO: 1318 - DNA, 1044 bp, Homo sapiens
taatacgactcactatagggaaataagagagaaaagaagagtaagaagaaatataagagccaccatgattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcacggatcccccatggagaacactgaaaactcagtggcttcaaaatccattaaaaatttggaaccaaagatcatacatggaagcgaatcaatggcctctggaatatccctggacaacagttataaaatggattatcctgagatgggtttatgtataataattaataataagaattttcataagagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagactgataataggctggagcctcggtggccatgcttcttgccccttgggcctccccccagcccctcctccccttcctgcacccgtacccccgtggtctttgaataaagtctgagtgggcggctctaga

SEQ ID NO: 1319 - DNA, 1089 bp, Homo sapiens
taatacgactcactatagggaaataagagagaaaagaagagtaagaagaaatataagagccaccatggtagaaatagatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaatctcgagcaccaccaccaccaccacgttgaaattgatgggggatcccccatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcatccaggcatgtcggggaaaccagcacgatgtgccagtcattcctttggatgtagtagattgataataggctggagcctcggtggccatgcttcttgccccttgggcctccccccagcccctcctccccttcctgcacccgtacccccgtggtctttgaataaagtctgagtgggcggctctaga

SEQ ID NO: 1320 - DNA, 1035 bp, Homo sapiens
taatacgactcactatagggaaataagagagaaaagaagagtaagaagaaatataagagccaccatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgataataggctggagcctcggtggccatgcttcttgccccttgggcctccccccagcccctcctccccttcctgcacccgtacccccgtggtctttgaataaagtctgagtgggcggctctaga

SEQ ID NO: 1321 - protein, 245 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 1322 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 1323 - protein, 255 aa, Homo sapiens
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 1324 - protein, 247 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 1325 - protein, 245 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 1326 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 1327 - protein, 246 aa, Homo sapiens; identical to SEQ ID NO: 1326

SEQ ID NO: 1328 - protein, 245 aa, Homo sapiens; identical to SEQ ID NO: 1321

SEQ ID NO: 1329 - protein, 168 aa, Homo sapiens
MAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 1330 - protein, 245 aa, Homo sapiens; identical to SEQ ID NO: 1325

SEQ ID NO: 1331 - protein, 245 aa, Homo sapiens; identical to SEQ ID NO: 1325

SEQ ID NO: 1332 - protein, 245 aa, Homo sapiens; identical to SEQ ID NO: 1325

SEQ ID NO: 1333 - protein, 245 aa, Homo sapiens; identical to SEQ ID NO: 1325

SEQ ID NO: 1334 - protein, 245 aa, Homo sapiens; identical to SEQ ID NO: 1325

SEQ ID NO: 1335 - protein, 233 aa, Homo sapiens
MVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 1336 - protein, 98 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVL

SEQ ID NO: 1337 - protein, 245 aa, Homo sapiens; identical to SEQ ID NO: 1325

SEQ ID NO: 1338 - protein, 100 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVL

SEQ ID NO: 1339 - protein, 92 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRD

SEQ ID NO: 1340 - protein, 74 aa, Homo sapiens
MTMDKSELVQKAKLAEQAERYDDMAAAMKAVTEQGHELSNEERNLLSVAYKNVVGARRSSWRVISSIEQKTERN

SEQ ID NO: 1341 - protein, 149 aa, Homo sapiens
MEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAY

SEQ ID NO: 1342 - protein, 207 aa, Homo sapiens
MVDREQLVQKARLAEQAERYDDMAAAMKNVTELNEPLSNEERNLLSVAYKNVVGARRSSWRVISSIEQKTSADGNEKKIEMVRAYREKIEKELEAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 1343 - protein, 245 aa, Homo sapiens; identical to SEQ ID NO: 1325

SEQ ID NO: 1344 - protein, 168 aa, Homo sapiens; identical to SEQ ID NO: 1329

SEQ ID NO: 1345 - protein, 125 aa, Homo sapiens
MKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 1346 - protein, 137 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDD

SEQ ID NO: 1347 - protein, 246 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKVRFGVSYPGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAE

SEQ ID NO: 1348 - protein, 170 aa, Homo sapiens
MSQPCRKLWRHNYETSSCIEFLKSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 1349 - protein, 125 aa, Homo sapiens; identical to SEQ ID NO: 1345

SEQ ID NO: 1350 - protein, 75 aa, Homo sapiens
MDKNELVQKAKLAEQAERYDDMAACMKSVTEQGAELSNEERNLLSVAYKNVVGARRSSWRVVSSIEQKTEGAEKK

SEQ ID NO: 1351 - protein, 130 aa, Homo sapiens
VFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 1352 - protein, 225 aa, Homo sapiens
MAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 1353 - protein, 210 aa, Homo sapiens [sequence omitted]

SEQ ID NO: 1354 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1355 - protein, 373 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 1356 - protein, 609 aa, Homo sapiens
MFRCGGLAAGALKQKLVPLVRTVCVRSPRQRNRLPVVQSHHLGSPSRSLASTGASGKDGSNLVYFLIVGATVTGAGVYYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1357 - protein, 598 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 1358 - protein, 586 aa, Homo sapiens
MGGALGLRQLPICAPACRPSSGHSPWAAASPNPNQWSSRSRWCCLRRSEARRSCRPVGRAAPGPTRAMARPATSTRRSACPPLTPTPALRIAWRLLSATSRTSRMASVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 1359 - protein, 326 aa, Homo sapiens
MFRCGGLAAGALKQKLVPLVRTVCVRSPRQRNRLPARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1360 - protein, 373 aa, Homo sapiens; identical to SEQ ID NO: 1355

SEQ ID NO: 1361 - protein, 336 aa, Homo sapiens
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEVQRSRFIVVVGGGSAGVEMAAEIKTEYPEKEVTLIHSQVALADKELLPSVRQEVKEILLRKGVQLLLTLLGERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 1362 - protein, 598 aa, Homo sapiens; identical to SEQ ID NO: 1357

SEQ ID NO: 1363 - protein, 605 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVELFVLHSKTGDMSWLTGKGS

SEQ ID NO: 1364 - protein, 604 aa, Homo sapiens
MGGCFSKPKPGAALPTVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVETGDMSWLTGKGS

SEQ ID NO: 1365 - protein, 270 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQV

SEQ ID NO: 1366 - protein, 605 aa, Homo sapiens; identical to SEQ ID NO: 1363

SEQ ID NO: 1367 - protein, 261 aa, Homo sapiens
MEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1368 - protein, 129 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCP

SEQ ID NO: 1369 - protein, 274 aa, Homo sapiens
MGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 1370 - protein, 237 aa, Homo sapiens
MKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKDI

SEQ ID NO: 1371 - protein, 479 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 1372 - protein, 438 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 1373 - protein, 465 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 1374 - protein, 480 aa, Homo sapiens [sequence omitted]

SEQ ID NO: 1375 - protein, 147 aa, Homo sapiens [sequence omitted]

SEQ ID NO: 1376 - protein, 479 aa, Homo sapiens; identical to SEQ ID NO: 1371

SEQ ID NO: 1377 - protein, 465 aa, Homo sapiens; identical to SEQ ID NO: 1373

SEQ ID NO: 1378 - protein, 382 aa, Homo sapiens
MRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 1379 - protein, 133 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTT

SEQ ID NO: 1380 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 1381 - protein, 480 aa, Homo sapiens [sequence omitted]

SEQ ID NO: 1382 - protein, 480 aa, Homo sapiens [sequence omitted]

SEQ ID NO: 1383 - protein, 133 aa, Homo sapiens; identical to SEQ ID NO: 1379

SEQ ID NO: 1384 - protein, 96 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDER

SEQ ID NO: 1385 - protein, 119 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDP

SEQ ID NO: 1386 - protein, 481 aa, Homo sapiens; identical to SEQ ID NO: 1380

SEQ ID NO: 1387 - protein, 67 aa, Homo sapiens
MNEVSVIKEGWLHKRGEYIKTWRPRYFLLKSDGSFIGYKERPEAPDQTLPPLNNFSVAECQLMKTER

SEQ ID NO: 1388 - protein, 134 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTE

SEQ ID NO: 1389 - protein, 107 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVA

SEQ ID NO: 1390 - protein, 288 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTVSCPPLPRQCEASLWTELRERALIFWYKAQSWGRPGGQGKVLLRPAKSSEPRHVVGVSRLGEWEGDSFFIDGGFM

SEQ ID NO: 1391 - protein, 418 aa, Homo sapiens
MKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASGTA

SEQ ID NO: 1392 - protein, 139 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTH

SEQ ID NO: 1393 - protein, 480 aa, Homo sapiens [sequence omitted]

SEQ ID NO: 1394 - protein, 480 aa, Homo sapiens [sequence omitted]

SEQ ID NO: 1395 - protein, 480 aa, Homo sapiens [sequence omitted]

SEQ ID NO: 1396 - protein, 92 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVET

SEQ ID NO: 1397 - protein, 298 aa, Homo sapiens
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 1398 - protein, 338 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKVVERCHWGILTDLLHKWNQS

SEQ ID NO: 1399 - protein, 1163 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 1400 - protein, 1205 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 1401 - protein, 1194 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 1402 - protein, 1205 aa, Homo sapiens; identical to SEQ ID NO: 1400

SEQ ID NO: 1403 - protein, 1163 aa, Homo sapiens; identical to SEQ ID NO: 1399

SEQ ID NO: 1404 - protein, 1237 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 1405 - protein, 1248 aa, Homo sapiens
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSGKDSVSGITSYVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLFDIHTSGLLGEIHTGHHSTIQYCDFSPQNHLAVVALSQYCVELWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 1406 - protein, 338 aa, Homo sapiens; identical to SEQ ID NO: 1398

SEQ ID NO: 1407 - protein, 250 aa, Homo sapiens [sequence omitted]

SEQ ID NO: 1408 - protein, 234 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKNDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 1409 - protein, 222 aa, Homo sapiens
MPASSPFLLAPKGPPGNMGGPVREPALSVALWLSWGAALGAVACAMALLTQQTELQSLRREVSRLQGTGGPSQNGEGYPWQSLPEQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 1410 - protein, 247 aa, Homo sapiens
MPASSPFLLAPKGPPGNMGGPVREPALSVALWLSWGAALGAVACAMALLTQQTELQSLRREVSRLQGTGGPSQNGEGYPWQSLPEQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGL

SEQ ID NO: 1411 - protein, 218 aa, Homo sapiens
MELLIMINACKIASASRVTAVIPCFPYARQDKKDKGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 1412 - protein, 168 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQVSVEAKYWCLKGGRKGLMMLKTAEKPKIMPKYI

SEQ ID NO: 1413 - protein, 251 aa, Homo sapiens
MELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 1414 - protein, 318 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 1415 - protein, 318 aa, Homo sapiens; identical to SEQ ID NO: 1414

SEQ ID NO: 1416 - protein, 621 aa, Homo sapiens
MEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 1417 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 1418 - protein, 1256 aa, Homo sapiens
TLQRASGAATEAPRRSEPPPGSGVPSGERAPERRRRRGGEGAARDGSCLARRARSSPELWLARRCGWAGDAAAVAARPGEMSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSDLSIAQAEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPGIKP

SEQ ID NO: 1419 - protein, 168 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 1420 - protein, 168 aa, Homo sapiens; identical to SEQ ID NO: 1419

SEQ ID NO: 1421 - protein, 149 aa, Homo sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSRRLR

SEQ ID NO: 1422 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 1423 - protein, 266 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 1424 - protein, 164 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGFIY

SEQ ID NO: 1425 - protein, 211 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 1426 - protein, 191 aa, Homo sapiens
MASGQGPGPPRQECGEPALPSASEEQVAQDTEEVFRSYVFYRHQQQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 1427 - protein, 211 aa, Homo sapiens; identical to SEQ ID NO: 1425

SEQ ID NO: 1428 - protein, 153 aa, Homo sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATRPAATPTACLRVASIGAVWWLFWASATVWPYTSTSMA

SEQ ID NO: 1429 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 1430 - protein, 192 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 1431 - protein, 143 aa, Homo sapiens
MDGSGEQPRGGGPTSSEQIMKTGALLLQGMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 1432 - protein, 41 aa, Homo sapiens
MDGSGEQPRGGVSSRIEQGEWGGRHPSWPWTRCLRMRPPRS

SEQ ID NO: 1433 - protein, 179 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWTVTIFVAGVLTASLTIWKKMG

SEQ ID NO: 1434 - protein, 164 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKAGVKWRDLGSLQPLPPGFKRFTCLSIPRSWDYRPCAPRCRN

SEQ ID NO: 1435 - protein, 239 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 1436 - protein, 239 aa, Homo sapiens; identical to SEQ ID NO: 1435

SEQ ID NO: 1437 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 1438 - protein, 204 aa, Homo sapiens
MVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWDGFCHFFRTPFPLAFWRKQLVQAFLSCLLTTAFIYLWTRLL

SEQ ID NO: 1439 - protein, 193 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTALYGDGALEEARRLREGNWASVRTVLTGAVALGALVTVGAFFASK

SEQ ID NO: 1440 - protein, 72 aa, Homo sapiens
MATPASAPDTRALVADFVGYKLRQKGYVCGAGPGEGPAADPLHQAMRAAGDEFETRFRRTFSDLAAQLHVTP

SEQ ID NO: 1441 - protein, 149 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTA

SEQ ID NO: 1442 - protein, 144 aa, Homo sapiens
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGW

SEQ ID NO: 1443 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 1444 - protein, 170 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQDTFVELYGNNAAAESRKGQERFNRWFLTGMTVAGVVLLGSLFSRK

SEQ ID NO: 1445 - protein, 233 aa, Homo sapiens; identical to SEQ ID NO: 1443

SEQ ID NO: 1446 - protein, 188 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGW

SEQ ID NO: 1447 - protein, 233 aa, Homo sapiens; identical to SEQ ID NO: 1443

SEQ ID NO: 1448 - protein, 188 aa, Homo sapiens; identical to SEQ ID NO: 1446

SEQ ID NO: 1449 - protein, 181 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPW

SEQ ID NO: 1450 - protein, 205 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRK

SEQ ID NO: 1451 - protein, 188 aa, Homo sapiens; identical to SEQ ID NO: 1446

SEQ ID NO: 1452 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1453 - protein, 135 aa, Homo sapiens
MLQMAGQCSQNEYFDSLLHACIPCQLRCSSNTPPLTCQRYCNARSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1454 - protein, 138 aa, Homo sapiens
MAGQCSQNEYFDSLLHACIPCQLRCSSNTPPLTCQRYCNASVTNSVKGTNAILWTCLGLSLIISLAVFVLMFLLRKINSEPLKDEFKNTEMESRSVAQAGVQWRDLNSLQPLPLGFKQFSHLSLLSNWDYRIRSPGHG

SEQ ID NO: 1455 - protein, 175 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 1456 - protein, 163 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWGKWHNHTPMLVESVAHKKRKMAL

SEQ ID NO: 1457 - protein, 241 aa, Homo sapiens
MCSGAGVMMARWAARGRAGWRSTVRILSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 1458 - protein, 137 aa, Homo sapiens
MDCEVNNGSSLRDECITNLLVFGFLQSCSDNSFRRELDALGHELPVLAPQWEGYDELQTDGNRSSHSRLGRIEAGASDNNTASAEEETEAAGSVAVERGLHGAATVILKVKKTSSGILPGTSPRSGTAWTVASLRAW

SEQ ID NO: 1459 - protein, 99 aa, Homo sapiens
MDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 1460 - protein, 99 aa, Homo sapiens; identical to SEQ ID NO: 1459

SEQ ID NO: 1461 - protein, 195 aa, Homo sapiens
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 1462 - protein, 195 aa, Homo sapiens; identical to SEQ ID NO: 1461

SEQ ID NO: 1463 - protein, 160 aa, Homo sapiens
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 1464 - protein, 138 aa, Homo sapiens
MAKQPSDVSSECDREGRQLQPAERPPQLRPGAPTSLQTEPQDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 1465 - protein, 112 aa, Homo sapiens
MAKQPSDVSSECDREGRQLQPAERPPQLRPGAPTSLQTEPQDRSPAPMSCDKSTQTPSPPCQAFNHYLSAMVVILEDIGDLSLCFGFIFTGLDLYGHHHSQDTEQLNHKDFS

SEQ ID NO: 1466 - protein, 172 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRMPLPPD

SEQ ID NO: 1467 - protein, 72 aa, Homo sapiens
MAKQPSDVSSECDREGRQLQPAERPPQLRPGAPTSLQTEPQGNPEGNHGGEGDSCPHGSPQGPLAPPASPGP

SEQ ID NO: 1468 - protein, 85 aa, Homo sapiens
MAKQPSDVSSECDREGRQLQPAERPPQLRPGAPTSLQTEPQASMRQAEPADMRPEIWIAQELRRIGDEFNAYYARRLAKLLASST

SEQ ID NO: 1469 - protein, 198 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQAFNHYLSAMASMRQAEPADMRPEIWIAQELRRIGDEFNAYYARRVFLNNYQAAEDHPRMVILRLLRYIVRLVWRMH

SEQ ID NO: 1470 - protein, 122 aa, Homo sapiens
MAKQPSDVSSECDREGRQLQPAERPPQLRPGAPTSLQTEPQGNPEGNHGGEGDSCPHGSPQGPLAPPASPGPFATRSPLFIFMRRSSLLSRSSSGYFSFDTDRSPAPMSCDKSTQTPSPPCQ

SEQ ID NO: 1471 - protein, 73 aa, Homo sapiens
MRQAEPADMRPEIWIAQELRRIGDEFNAYYARRVMMFSLPAFLLTPSPSTLYFFKKTVTSCNYMLILEMITVA

SEQ ID NO: 1472 - protein, 129 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYAPAEPKSCVVADPPLPAQPCFEWRREQERGRP

SEQ ID NO: 1473 - protein, 184 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEVQIARKLQCIADQFHRLHVQQHQQNQNRVWWQILLFLHNLALNGEENRNGAGPR

SEQ ID NO: 1474 - protein, 184 aa, Homo sapiens; identical to SEQ ID NO: 1473

SEQ ID NO: 1475 - protein, 163 aa, Homo sapiens
MEPSQCVEELEDDVFQPEDGEPVTQPGSLLSADLFAQSLLDCPLSRLQLFPLTHCCGPGLRPTSQEDKATQTLSPASPSQGVMLPCGVTEEPQRLFYGNAGYRLPLPASFPAVLPIGEQPPEGQWQHQAEHQQNQNRVWWQILLFLHNLALNGEENRNGAGPR

SEQ ID NO: 1476 - protein, 129 aa, Homo sapiens; identical to SEQ ID NO: 1472

SEQ ID NO: 1477 - protein, 184 aa, Homo sapiens; identical to SEQ ID NO: 1473

SEQ ID NO: 1478 - protein, 184 aa, Homo sapiens; identical to SEQ ID NO: 1473

SEQ ID NO: 1479 - protein, 383 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 1480 - protein, 415 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRNWPSSRGPPWRASEGERTAQ

SEQ ID NO: 1481 - protein, 376 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKRESNRDGEESSSA

SEQ ID NO: 1482 - protein, 285 aa, Homo sapiens
NWNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 1483 - protein, 383 aa, Homo sapiens; identical to SEQ ID NO: 1479

SEQ ID NO: 1484 - protein, 376 aa, Homo sapiens; identical to SEQ ID NO: 1481

SEQ ID NO: 1485 - protein, 153 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGE

SEQ ID NO: 1486 - protein, 469 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 1487 - protein, 511 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 1488 - protein, 521 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 1489 - protein, 423 aa, Homo sapiens
MKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 1490 - protein, 289 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 1491 - protein, 454 aa, Homo sapiens
MSEPKAIDPKLSTTDRVVKVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 1492 - protein, 132 aa, Homo sapiens
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAF

SEQ ID NO: 1493 - protein, 147 aa, Homo sapiens
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLC

SEQ ID NO: 1494 - protein, 88 aa, Homo sapiens
MADKVLKEKRKLFIRSMGEDNVSWRHPTMGSVFIGRLIEHMQEYACSCDVEEIFRKVRFSFEQPDGRAQMPTTERVTLTRCFYLFPGH

SEQ ID NO: 1495 - protein, 383 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSAAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1496 - protein, 88 aa, Homo sapiens; identical to SEQ ID NO: 1494

SEQ ID NO: 1497 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1498 - protein, 263 aa, Homo sapiens
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDNVSWRHPTMGSVFIGRLIEHMQEYACSCDVEEIFRKVRFSFEQPDGRAQMPTTERVTLTRCFYLFPGH

SEQ ID NO: 1499 - protein, 383 aa, Homo sapiens; identical to SEQ ID NO: 1495

SEQ ID NO: 1500 - protein, 311 aa, Homo sapiens
MADKVLKEKRKLFIRSMGEAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 1501 - protein, 301 aa, Homo sapiens
MEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPGKSQS

SEQ ID NO: 1502 - protein, 110 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADLSNNGQVKPHTSCSHYLQ

SEQ ID NO: 1503 - protein, 88 aa, Homo sapiens; identical to SEQ ID NO: 1494

SEQ ID NO: 1504 - protein, 404 aa, Homo sapiens; identical to SEQ ID NO: 1497

SEQ ID NO: 1505 - protein, 263 aa, Homo sapiens; identical to SEQ ID NO: 1498

SEQ ID NO: 1506 - protein, 521 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 1507 - protein, 522 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 1508 - protein, 479 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 1509 - protein, 273 aa, Homo sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNEGSCVQDESEPQRPLCHCQQPQLYLPEGQTRNP

SEQ ID NO: 1510 - protein, 452 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 1511 - protein, 108 aa, Homo sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALHS

SEQ ID NO: 1512 - protein, 313 aa, Homo sapiens
MHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGAGAIGSLGHLLLFTAATASLAL

SEQ ID NO: 1513 - protein, 277 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 1514 - protein, 156 aa, Homo sapiens
MSDALIKVSMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKNNKLFQRGSL

SEQ ID NO: 1515 - protein, 117 aa, Homo sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCV

SEQ ID NO: 1516 - protein, 277 aa, Homo sapiens; identical to SEQ ID NO: 1513

SEQ ID NO: 1517 - protein, 330 aa, Homo sapiens
MLKLKTKFGSWQTLCKRSNVWQDKCFFKPFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 1518 - protein, 147 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFD

SEQ ID NO: 1519 - protein, 377 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 1520 - protein, 434 aa, Homo sapiens
MAEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 1521 - protein, 133 aa, Homo sapiens
MLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKHLSNKKERGPQTPGSHHMQYKV

SEQ ID NO: 1522 - protein, 447 aa, Homo sapiens
MAAVPRVEGVFIFLIEDSGKKKRRKNFEAMFKGILQSGLDNFVINHMLKNNVAGQTSIQTLVPNTDQKSTSVKKDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 1523 - protein, 292 aa, Homo sapiens
MAALLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 1524 - protein, 376 aa, Homo sapiens
MAEDNHKKKTVKMLEYLGKDVLHGVFNYLAKHDVLTLKEEEKKKYYDTKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 1525 - protein, 447 aa, Homo sapiens; identical to SEQ ID NO: 1522

SEQ ID NO: 1526 - protein, 292 aa, Homo sapiens; identical to SEQ ID NO: 1523

SEQ ID NO: 1527 - protein, 293 aa, Homo sapiens
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 1528 - protein, 204 aa, Homo sapiens
MSSASGLRRGHPAVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 1529 - protein, 303 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 1530 - protein, 303 aa, Homo sapiens; identical to SEQ ID NO: 1529

SEQ ID NO: 1531 - protein, 220 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSVTQAGVQRRDLGRLQPPPPRFKQYSCLSLLSSWDYRHAPPRLANFCIFRREGFRHVGQAGLKLLASSDPPTSGSQSAGITGVSLHTQPQIMKVSLRHCNTFICFA

SEQ ID NO: 1532 - protein, 303 aa, Homo sapiens; identical to SEQ ID NO: 1529

SEQ ID NO: 1533 - protein, 220 aa, Homo sapiens [sequence omitted]

SEQ ID NO: 1534 - protein, 336 aa, Homo sapiens
MDCVGWPPGRKWHLEKNTSCGGSSGICASYVTQMADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 1535 - protein, 253 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENMESCSVTQAGVQRRDLGRLQPPPPRLAEGPSLMMASRPTRGPSMTQMLILDTRSQWKLTSSSPIPRFQAITRGGAQEEAPGLCKPSAPSWRSTEKTWKSCRSSPG

SEQ ID NO: 1536 - protein, 222 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFA

SEQ ID NO: 1537 - protein, 264 aa, Homo sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 1538 - protein, 278 aa, Homo sapiens
MQRGLFSDGDTSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 1539 - protein, 395 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 1540 - protein, 496 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRFHFCRMSWAEANSQCQTQSVPFWRRVDHLLIRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 1541 - protein, 464 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 1542 - protein, 538 aa, Homo sapiens
MEGGRRARVVIESKRNFFLGAFPTPFPAEHVELGRLGDSETAMVPGKGGADYILLPFKKMDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 1543 - protein, 235 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNDFGQSLPNEKQTSGILSDHQQSQFCKSTGESAQTSQH

SEQ ID NO: 1544 - protein, 235 aa, Homo sapiens; identical to SEQ ID NO: 1543

SEQ ID NO: 1545 - protein, 278 aa, Homo sapiens [sequence omitted]

SEQ ID NO: 1546 - protein, 464 aa, Homo sapiens; identical to SEQ ID NO: 1541

SEQ ID NO: 1547 - protein, 220 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCKSTGESAQTSQH

SEQ ID NO: 1548 - protein, 198 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSN

SEQ ID NO: 1549 - protein, 116 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSE

SEQ ID NO: 1550 - protein, 479 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 1551 - protein, 124 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLL

SEQ ID NO: 1552 - protein, 209 aa, Homo sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKDFGQSLPNEKQTSGILSDHQQSQFCK

SEQ ID NO: 1553 - protein, 416 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1554 - protein, 266 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1555 - protein, 200 aa, Homo sapiens
MEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGGFVSWRDPKSGSWYVETLDDIFEQWAHSEDLQSLLLRVANAVSVKGIYKQMPGCFNFLRKKLFFKTS

SEQ ID NO: 1556 - protein, 333 aa, Homo sapiens
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 1557 - protein, 254 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKASHLQFPGAVYGTDGCPVSVEKIVNIFNGTSCPSLGGKPKLFFI

SEQ ID NO: 1558 - protein, 266 aa, Homo sapiens
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFP

SEQ ID NO: 1559 - protein, 421 aa, Homo sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVSAAFLCKGEGRLLRGSVSSWGWGFGVSRAGPNQG

SEQ ID NO: 1560 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 1561 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSRARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 1562 - protein, 132 aa, Homo sapiens
MSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 1563 - protein, 483 aa, Homo sapiens
MFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSRARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 1564 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 1565 - protein, 261 aa, Homo sapiens
GRSPLRTRDRVLTNWEDGLTVAYGAVKLIQSLSLQPVGWQQNWGLSSPPTMLLPSRAQSPTELPLAPLAEPNTGCSSLLSWHSTRGELHLWALGLGQMGGSKCGSPLSPLAPTLEALRRPWCGQQGAGGTRGISTDPPSGKGGRAWGRDPLPREGLLRGTAAPAAGGDLTPCLSRPPTPSRNPRRSIFPTIFLAPTLLLQCRRLYMDANRSPRRMAKRVASQCRRDSEAAPTQECGHVGKQAVGQRAWCCCCCGVRVRGWH

SEQ ID NO: 1566 - protein, 240 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 1567 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 1568 - protein, 203 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTRSPGSAESPGGDPHHLRDPVCHPLGAGLYQKGGQEANQ

SEQ ID NO: 1569 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 1570 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 1571 - protein, 208 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 1572 - protein, 240 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 1573 - protein, 240 aa, Homo sapiens; identical to SEQ ID NO: 1572

SEQ ID NO: 1574 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 1575 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEAITLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 1576 - protein, 189 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEAITLWYRSPEVLLGSARYSTPVDIWS

SEQ ID NO: 1577 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 1578 - protein, 307 aa, Homo sapiens
MGTVLSLSPSYRKATLFEDGAATVGHYTAVQNSKNAKDKNLKRHSIISVLPWKRIVAVSAKKKNSKKVQPNSSYQNNITHLNNENLKKSLSCANLSTFAQPPPAQPPAPPASQLSGSQTGGSSSVKKAPHPAVTSAGTPKRVIVQASTSELLRCLGEFLCRRCYRLKHLSPTDPVLWLRSVDRSLLLQGWQDQGFITPANVVFLYMLCRDVISSEVGSDHELQAVLLTCLYLSYSYMGNEISYPLKPFLVESCKEAFWDRCLSVINLMSSKMLQINADPHYFTQVFSDLKNESGQEDKKRLLLGLDR

SEQ ID NO: 1579 - protein, 480 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 1580 - protein, 462 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 1581 - protein, 348 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFREEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERGTIPGSGITESKDMHFSSLGCILLDVL

SEQ ID NO: 1582 - protein, 300 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETENAHSWIFTLNSMATCMIGTAEFLPRRNIMSGCSTL

SEQ ID NO: 1583 - protein, 250 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEKSFLDLVVELEKLNLVAPDQLDLLEKCLKNIHRIDLKTKIQKYKQSGGWNGTWMTKASFSLWLEIASLYILHIPDLPTPLPCIFMISAKCCQAVLNISVFKKESGICTGWQSYGHSGVLHVC

SEQ ID NO: 1584 - protein, 118 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKD

SEQ ID NO: 1585 - protein, 480 aa, Homo sapiens; identical to SEQ ID NO: 1579

SEQ ID NO: 1586 - protein, 64 aa, Homo sapiens
MSAEVIHQVEEALDTDEKEMLLFLCRDVAIDVVPPNVRDLLDILRERGKLSVGDLAELLYRVRR

SEQ ID NO: 1587 - protein, 129 aa, Homo sapiens
MSAEVIHQVEEALDTDEKEMLLFLCRDVAIDVVPPNVRDLLDILRERGKLSVGDLAELLYRVRRFDLLKRILKMDRKAVETHLLRNPHLVSDYRVLMAEIGEDLDKSDVSSLIFLMKDYMGRGKISKEK

SEQ ID NO: 1588 - protein, 384 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGKPKMFFIQNYVVSEGQLEDSSLLEVDGPAMKNVEFKAQKRGLCTVHREADFFWSLCTADMSLLEQSHSSPSLYLQCLSQKLRQERKRPLLDLHIELNGYMYDWNSRVSAKEKYYVWLQHTLRKKLILSYT

SEQ ID NO: 1589 - protein, 618 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 1590 - protein, 604 aa, Homo sapiens
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 1591 - protein, 604 aa, Homo sapiens; identical to SEQ ID NO: 1590

SEQ ID NO: 1592 - protein, 604 aa, Homo sapiens; identical to SEQ ID NO: 1590

SEQ ID NO: 1593 - protein, 618 aa, Homo sapiens; identical to SEQ ID NO: 1589

SEQ ID NO: 1594 - protein, 569 aa, Homo sapiens
MSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 1595 - protein, 597 aa, Homo sapiens
MEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 1596 - protein, 534 aa, Homo sapiens [sequence omitted]

SEQ ID NO: 1597 - protein, 331 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 1598 - protein, 648 aa, Homo sapiens [sequence omitted]

SEQ ID NO: 1599 - protein, 668 aa, Homo sapiens
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIENNNLSASPRAWSRRFCLRGRDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 1600 - protein, 433 aa, Homo sapiens
MCVDWSNIRQLFSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 1601 - protein, 567 aa, Homo sapiens
MMANSQILLRQATLSVFSCRTSKEQCKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 1602 - protein, 105 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 1603 - protein, 105 aa, Homo sapiens; identical to SEQ ID NO: 1602

SEQ ID NO: 1604 - protein, 105 aa, Homo sapiens; identical to SEQ ID NO: 1602

SEQ ID NO: 1605 - protein, 101 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKK

SEQ ID NO: 1606 - protein, 740 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 1607 - protein, 740 aa, Homo sapiens; identical to SEQ ID NO: 1606

SEQ ID NO: 1608 - protein, 740 aa, Homo sapiens; identical to SEQ ID NO: 1606

SEQ ID NO: 1609 - protein, 740 aa, Homo sapiens; identical to SEQ ID NO: 1606

SEQ ID NO: 1610 - protein, 740 aa, Homo sapiens; identical to SEQ ID NO: 1606

SEQ ID NO: 1611 - protein, 740 aa, Homo sapiens; identical to SEQ ID NO: 1606

SEQ ID NO: 1612 - protein, 665 aa, Homo sapiens
MQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 1613 - protein, 130 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINEL

SEQ ID NO: 1614 - protein, 130 aa, Homo sapiens; identical to SEQ ID NO: 1613

SEQ ID NO: 1615 - protein, 178 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQS

SEQ ID NO: 1616 - protein, 178 aa, Homo sapiens; identical to SEQ ID NO: 1615

SEQ ID NO: 1617 - protein, 740 aa, Homo sapiens; identical to SEQ ID NO: 1606

SEQ ID NO: 1618 - protein, 740 aa, Homo sapiens; identical to SEQ ID NO: 1606

SEQ ID NO: 1619 - protein, 130 aa, Homo sapiens; identical to SEQ ID NO: 1613

SEQ ID NO: 1620 - protein, 178 aa, Homo sapiens; identical to SEQ ID NO: 1615

SEQ ID NO: 1621 - protein, 740 aa, Homo sapiens; identical to SEQ ID NO: 1606

SEQ ID NO: 1622 - protein, 178 aa, Homo sapiens; identical to SEQ ID NO: 1615

SEQ ID NO: 1623 - protein, 130 aa, Homo sapiens; identical to SEQ ID NO: 1613

SEQ ID NO: 1624 - protein, 130 aa, Homo sapiens; identical to SEQ ID NO: 1613

SEQ ID NO: 1625 - protein, 178 aa, Homo sapiens; identical to SEQ ID NO: 1615

SEQ ID NO: 1626 - protein, 740 aa, Homo sapiens; identical to SEQ ID NO: 1606

SEQ ID NO: 1627 - protein, 665 aa, Homo sapiens; identical to SEQ ID NO: 1612

SEQ ID NO: 1628 - protein, 665 aa, Homo sapiens; identical to SEQ ID NO: 1612

SEQ ID NO: 1629 - protein, 665 aa, Homo sapiens; identical to SEQ ID NO: 1612

SEQ ID NO: 1630 - protein, 665 aa, Homo sapiens; identical to SEQ ID NO: 1612

SEQ ID NO: 1631 - protein, 140 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACCGCCRRCAWPGCPGWSGASVSASSLCT

SEQ ID NO: 1632 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 1633 - protein, 300 aa, Homo sapiens; identical to SEQ ID NO: 1632

SEQ ID NO: 1634 - protein, 270 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIDGVLLCGPG

SEQ ID NO: 1635 - protein, 274 aa, Homo sapiens
MCLLLDRHLLFVPLVADVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 1636 - protein, 103 aa, Homo sapiens
MLQKPKSVKLRALRSPRKFGVAGRSCQEVLRKGCLRFQLPERGSRLCLYEDGTELTEDYFPSVPDNAELVLLTLGQAWQGWFRHVSQDSLTLLGSSCPPALVS

SEQ ID NO: 1637 - protein, 274 aa, Homo sapiens; identical to SEQ ID NO: 1635

SEQ ID NO: 1638 - protein, 338 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 1639 - protein, 116 aa, Homo sapiens
MLQKPKSVKLRALRSPRKFGVAGRSCQEVLRKGCLRFQLPERGSRLCLYEDGTELTEDYFPSVPDNAELVLLTLGQAWQGSVGVRARTKTRDTSSLSPGDCQALGNGGRCGQRLFL

SEQ ID NO: 1640 - protein, 86 aa, Homo sapiens [sequence omitted]

SEQ ID NO: 1641 - protein, 82 aa, Homo sapiens
MLQKPKSVKLRALRSPRKFGVAGRSCQEVLRKGCLRFQLPERGSRLCLYEDGTELTEDYFPSVPDNAELVLLTLGQAWQGCE

SEQ ID NO: 1642 - protein, 270 aa, Homo sapiens; identical to SEQ ID NO: 1634

SEQ ID NO: 1643 - protein, 372 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1644 - protein, 234 aa, Homo sapiens
MEQRPRGCAAVAAALLLVLLGARAQGGTRSPRCDCAGDFHKKIGLFCCRGCPADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1645 - protein, 380 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1646 - protein, 417 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1647 - protein, 426 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 1648 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 1649 - protein, 440 aa, Homo sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 1650 - protein, 411 aa, Homo sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 1651 - protein, 260 aa, Homo sapiens
MCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 1652 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 1653 - protein, 344 aa, Homo sapiens
SCCRPWRPLGARSPARPSRPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 1654 - protein, 1210 aa, Homo sapiens [sequence omitted]

SEQ ID NO: 1655 - protein, 628 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 1656 - protein, 705 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 1657 - protein, 1080 aa, Homo sapiens
NRTEGAAHEKFTGNPAWRRAVQQQPCPVVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 1658 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 1659 - protein, 657 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 1660 - protein, 1157 aa, Homo sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 1661 - protein, 1091 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 1662 - protein, 464 aa, Homo sapiens
MSSLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRR

SEQ ID NO: 1663 - protein, 1255 aa, Homo sapiens [sequence omitted]

SEQ ID NO: 1664 - protein, 1225 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 1665 - protein, 979 aa, Homo sapiens
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 1666 - protein, 603 aa, Homo sapiens
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 1667 - protein, 1225 aa, Homo sapiens; identical to SEQ ID NO: 1664

SEQ ID NO: 1668 - protein, 1240 aa, Homo sapiens
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 1669 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 1670 - protein, 331 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKVF

SEQ ID NO: 1671 - protein, 183 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 1672 - protein, 1283 aa, Homo sapiens
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 1673 - protein, 699 aa, Homo sapiens
MALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 1674 - protein, 126 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTN

SEQ ID NO: 1675 - protein, 921 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 1676 - protein, 360 aa, Homo sapiens [sequence omitted]

SEQ ID NO: 1677 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 1678 - protein, 335 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 1679 - protein, 311 aa, Homo sapiens
MVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 1680 - protein, 335 aa, Homo sapiens; identical to SEQ ID NO: 1678

SEQ ID NO: 1681 - protein, 360 aa, Homo sapiens [sequence omitted]

SEQ ID NO: 1682 - protein, 357 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVGQSPAAVGLGAGEQGGT

SEQ ID NO: 1683 - protein, 348 aa, Homo sapiens
MVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 1684 - protein, 265 aa, Homo sapiens
MRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 1685 - protein, 316 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILALDLLDKMLTFNPHKRIEVEQALAHPYLEQYYDPSDEPIAEAPFKFDMELDDLPKEKLKELIFEETARFQPGYRS

SEQ ID NO: 1686 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 1687 - protein, 1982 aa, Homo sapiens
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQNINRKEVKSQDKEERKVDQKPKSVVKDQDHWRRSERASLPHSKNEITFSHNSSKYHLEERRGWEDCKRDKSVNSHSFQDGRCPSSLSNSRTHKNIDSKEVDAMHQWENTPLKAERHRTEDKRKREQESKEENRHIRNEKRVPTEHLQKTNKETKKTTTDLKKQNEPKTDKGEVLDNGVSEGADNKELAMKAESGPNETKNKDLKLSFMKKLNLTLSPAKKQPVSQDNQHKITDIPKSSGVCDSESSMQVKTVAYVPSISEHILGEAAVSEHTMGETKSTLLEPKVALLAVTEPRIGISETNKEDENSLLVRSVDNTMHCEEPICGTETSFPSPMEIQQTESLFPSTGMKQTINNGRAAAPVVMDVLQTDVSQNFGLELDTKRNDNSDYCGISEGMEMKVALSTTVSETTESILQPSIEEADILPIMLSEDNNPKFEPSVIVTPLVESKSCHLEPCLPKETLDSSLQQTELMDHRMATGETNSVYHDDDNSVLSIDLNHLRPIPEAISPLNSPVRPVAKVLRNESPPQVPVYNNSHKDVFLPNSAHSTSKSQSDLNKENQKPIYKSDKCTEADTCKNSPLDELEEGEIRSDSETSKPQESFEKNSKRRVSADVRKSKTIPRRGKSTVCLDKDSRKTHVRIHQTNNKWNKRPDKSSRSSKTEKKDKVMSTSSLEKIVPIIAVPSSEQEIMHMLRMIRKHVRKNYMKFKAKFSLIQFHRIIESAILSFTSLIKHLNLHKISKSVTTLQKNLCDIIESKLKQVKKNGIVDRLFEQQLPDMKKKLWKFVDDQLDYLFAKLKKILVCDSKSFGRDSDEGKLEKTSKQNAQYSNSQKRSVDNSNRELLKEKLSKSEDPVHYKSLVGCKKSEENYQDQNNSSINTVKHDIKKNFNICFDNIKNSQSEERSLEVHCPSTPKSEKNEGSSIEDAQTSQHATLKPERSFEILTEQQASSLTFNLVSDAQMGEIFKSLLQGSDLLDSSVNCTEKSEWELKTPEKQLLETLKCESIPACTTEELVSGVASPCPKMISDDNWSLLSSEKGPSLSSGLSLPVHPDVLDESCMFEVSTNLPLSKDNVCSVEKSKPCVSSILLEDLAVSLTVPSPLKSDGHLSFLKPDMSSSSTPEEVISAHFSEDALLEEEDASEQDIHLALESDNSSSKSSCSSSWTSRSVAPGFQYHPNLPMHAVIMEKSNDHFIVKIRRATPSTSSGLKQSMMPDELLTSLPRHGKEADEGPEKEYISCQNTVFKSVEELENSNKNVDGSKSTHEEQSSMIQTQVPDIYEFLKDASDKMGHSDEVADECFKLHQVWETKVPESIEELPSMEEISHSVGEHLPNTYVDLTKDPVTETKNLGEFIEVTVLHIDQLGCSGGNLNQSAQILDNSLQADTVGAFIDLTQDASSEAKSEGNHPALAVEDLGCGVIQVDEDNCKEEKAQVANRPLKCIVEETYIDLTTESPSSCEVKKDELKSEPGSNCDNSELPGTLHNSHKKRRNISDLNHPHKKQRKETDLTNKEKTKKPTQDSCENTEAHQKKASKKKAPPVTKDPSSLKATPGIKDSSAALATSTSLSAKNVIKKKGEIIILWTRNDDREILLECQKRGPSFKTFAYLAAKLDKNPNQVSERFQQLMKLFEKSKCR

SEQ ID NO: 1688 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 1689 - protein, 94 aa, Homo sapiens
MARGSLRRLLRLLVLGLWLALLRSVAGEQAPGAAAPPAPFRLLWPILGGALSLTFVLGLLSGFLVWRRCRRREKFTTPIEETGGEGCPAVALIQ

SEQ ID NO: 1690 - protein, 820 aa, Homo sapiens
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 1691 - protein, 176 aa, Homo sapiens
MEAIAKYDFKATADDELSFKRGDILKVLNEECDQNWYKAELNGKDGFIPKNYIEMKPHPFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 1692 - protein, 217 aa, Homo sapiens [sequence omitted]

SEQ ID NO: 1693 - protein, 217 aa, Homo sapiens [sequence omitted]

SEQ ID NO: 1694 - protein, 217 aa, Homo sapiens [sequence omitted]

SEQ ID NO: 1695 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 1696 - protein, 170 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPPGPM

SEQ ID NO: 1697 - protein, 189 aa, Homo sapiens; identical to SEQ ID NO: 1695

SEQ ID NO: 1698 - protein, 170 aa, Homo sapiens; identical to SEQ ID NO: 1696

SEQ ID NO: 1699 - protein, 189 aa, Homo sapiens; identical to SEQ ID NO: 1695

SEQ ID NO: 1700 - protein, 170 aa, Homo sapiens; identical to SEQ ID NO: 1696

SEQ ID NO: 1701 - protein, 91 aa, Homo sapiens
MCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 1702 - protein, 205 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 1703 - protein, 150 aa, Homo sapiens
MAKIILRHLIEIPVRYQEEFEARGLEDCRLDHALYALPGPTIVDLRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 1704 - protein, 182 aa, Homo sapiens
MSGRSVPHAHPATAEYEFANPSRLGEQRFGEGLLPEEILTPTLYHGYYVRPRAAPAGEGSRAGASELRLSEGKFQAFLDVSHFTPDEVTVRTVDNLLEVSARHPQRLDRHGFVSREFCRTYVLPADVDPWRVRAALSHDGILNLEAPRGGRHLDTEVNEVYISLLPAPPDPEEEEEAAIVEP

SEQ ID NO: 1705 - protein, 170 aa, Homo sapiens
MTERRVPFSLLRGPSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 1706 - protein, 182 aa, Homo sapiens; identical to SEQ ID NO: 1704

SEQ ID NO: 1707 - protein, 458 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 1708 - protein, 361 aa, Homo sapiens
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKFGNSGGPLVNLDGEVIGVNTMKVTAGISFAIPSDRLREFLHRGEKKNSSSGISGSQRRYIGVMMLTLSPRAGLRPGDVILAIGEQMVQNAEDVYEAVRTQSQLAVQIRRGRETLTLYVTPEVTE

SEQ ID NO: 1709 - protein, 28 aa, Homo sapiens
MATQGFSCLLLSVSEIDLSMKRQYKQIR

SEQ ID NO: 1710 - protein, 24 aa, Homo sapiens
MATPGFSCLLLSTSEIDLPMKRRV

SEQ ID NO: 1711 - protein, 24 aa, Homo sapiens
MAPRGFSCLLLSTSEIDLPVKRRA

SEQ ID NO: 1712 - protein, 24 aa, Homo sapiens
MAPRGFSCLLLSTSEIDLPVKRRT

SEQ ID NO: 1713 - protein, 24 aa, Homo sapiens
MATRRFSCLLLSTSEIDLSVKRRI

SEQ ID NO: 1714 - protein, 24 aa, Homo sapiens
MATGGFGCLLLLIREIDLSVKRQI

SEQ ID NO: 1715 - protein, 24 aa, Homo sapiens
MTTRGFSCLLLLIREIDLSAKRRI

SEQ ID NO: 1716 - protein, 24 aa, Homo sapiens
MTPRGFSCLLLPTSETDLPVKRRT

SEQ ID NO: 1717 - protein, 268 aa, Homo sapiens
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLEVGGNQGH

SEQ ID NO: 1718 - protein, 331 aa, Homo sapiens
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 1719 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 1720 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLVVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMELQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 1721 - protein, 533 aa, Homo sapiens
MSSDGTIRHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 1722 - protein, 697 aa, Homo sapiens
MSSDGTIRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 1723 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 1724 - protein, 368 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 1725 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 1726 - protein, 419 aa, Homo sapiens; identical to SEQ ID NO: 1725

SEQ ID NO: 1727 - protein, 419 aa, Homo sapiens; identical to SEQ ID NO: 1725

SEQ ID NO: 1728 - protein, 487 aa, Homo sapiens
MALVIQVGKLRPREVRTPQTINPSLFPSLPVKLSSIIEVPSGGERCCSRRTLVYKARAFWKGAPLPCWMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 1729 - protein, 206 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQG

SEQ ID NO: 1730 - protein, 251 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVG

SEQ ID NO: 1731 - protein, 138 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAED

SEQ ID NO: 1732 - protein, 418 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 1733 - protein, 712 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1734 - protein, 693 aa, Homo sapiens
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1735 - protein, 682 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1736 - protein, 708 aa, Homo sapiens
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 1737 - protein, 625 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 1738 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 1739 - protein, 171 aa, Homo sapiens
LQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 1740 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 1741 - protein, 218 aa, Homo sapiens [sequence omitted]

SEQ ID NO: 1742 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 1743 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 1744 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 1745 - protein, 427 aa, Homo sapiens; identical to SEQ ID NO: 1740

SEQ ID NO: 1746 - protein, 308 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 1747 - protein, 142 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHL

SEQ ID NO: 1748 - protein, 97 aa, Homo sapiens
MIIGLLNVFTPQKSLEEFQDVYIVMELMDANLCQVIQMELDHERMSYLLYQMLCGIKHLHSAGIIHRDLKPSNIVVKSDCTLKILDFGLARTAGTSF

SEQ ID NO: 1749 - protein, 142 aa, Homo sapiens; identical to SEQ ID NO: 1747

SEQ ID NO: 1750 - protein, 464 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1751 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 1752 - protein, 319 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1753 - protein, 277 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 1754 - protein, 422 aa, Homo sapiens; identical to SEQ ID NO: 1751

SEQ ID NO: 1755 - protein, 426 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1756 - protein, 426 aa, Homo sapiens; identical to SEQ ID NO: 1755

SEQ ID NO: 1757 - protein, 319 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1758 - protein, 33 aa, Homo sapiens
MSKSKVDNQFYSVEVGDSTFTVLKRYQNLKPIG

SEQ ID NO: 1759 - protein, 51 aa, Homo sapiens
MSLHFLYYCSEPTLDVKIAFCQGFDKQVDVSYIAKHYNMSKSKVDNQFYSV

SEQ ID NO: 1760 - protein, 91 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVA

SEQ ID NO: 1761 - protein, 74 aa, Homo sapiens
MSKSKVDNQFYSVEVGDSTFTVLKRYQNLKPIGSGAQGIVCAAYDAVLDRNVAIKKLSRPFQNQTHAKRAYREL

SEQ ID NO: 1762 - protein, 121 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHK

SEQ ID NO: 1763 - protein, 117 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKC

SEQ ID NO: 1764 - protein, 141 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQD

SEQ ID NO: 1765 - protein, 84 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKN

SEQ ID NO: 1766 - protein, 335 aa, Homo sapiens
  misc_feature (1)..(1): Xaa can be any naturally occurring amino acid
XNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 1767 - protein, 380 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 1768 - protein, 728 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 1769 - protein, 699 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 1770 - protein, 615 aa, Homo sapiens
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 1771 - protein, 82 aa, Homo sapiens
MFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 1772 - protein, 480 aa, Homo sapiens
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPPGGRLGHLQSQCDS

SEQ ID NO: 1773 - protein, 271 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 1774 - protein, 350 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 1775 - protein, 279 aa, Homo sapiens
MFGLKRNAVIGLNLYCGGAGLGAGSGGATRPGGRLLATEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 1776 - protein, 360 aa, Homo sapiens [sequence omitted]

SEQ ID NO: 1777 - protein, 393 aa, Homo sapiens [sequence omitted]

SEQ ID NO: 1778 - protein, 348 aa, Homo sapiens; identical to SEQ ID NO: 1683

SEQ ID NO: 1779 - protein, 316 aa, Homo sapiens; identical to SEQ ID NO: 1685

SEQ ID NO: 1780 - protein, 400 aa, Homo sapiens [sequence omitted]

SEQ ID NO: 1781 - protein, 399 aa, Homo sapiens
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 1782 - protein, 410 aa, Homo sapiens
MAAPSPSGGGGSGGGSGSGTPGPVGSPAPGHPAVSSMQGFQINFCEKAQSKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 1783 - protein, 271 aa, Homo sapiens
ICERIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 1784 - protein, 376 aa, Homo sapiens [sequence omitted]

SEQ ID NO: 1785 - protein, 1512 aa, Homo sapiens
MAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 1786 - protein, 111 aa, Homo sapiens
MANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 1787 - protein, 101 aa, Homo sapiens
MEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 1788 - protein, 101 aa, Homo sapiens; identical to SEQ ID NO: 1787

SEQ ID NO: 1789 - protein, 111 aa, Homo sapiens; identical to SEQ ID NO: 1786

SEQ ID NO: 1790 - protein, 111 aa, Homo sapiens; identical to SEQ ID NO: 1786

SEQ ID NO: 1791 - protein, 241 aa, Homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 1792 - protein, 427 aa, Homo sapiens
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 1793 - protein, 333 aa, Homo sapiens
MSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 1794 - protein, 946 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 1795 - protein, 433 aa, Homo sapiens
CFKQLGEGLRALPRSELHKLISPLQCLNHVWKLHHPQDGGPLPLPTHHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKVGDGTQHGQQGELQGPGAQAAGWRGCSAVADGARGGLVIHVGS

SEQ ID NO: 1796 - protein, 136 aa, Homo sapiens
MPGKKARKNAQPSPARAPAGPAGTAGTARDQAGFAIGMQLRFTRGKKLLSSSLSSSPLALPRGHEEQVQVAGSRVCYSTQEIWRQTELPAETSESDIQTLLLRNLTASKTCMRGLLQKSFLRRCTFHQFEERLHCN

SEQ ID NO: 1797 - protein, 54 aa, Homo sapiens
MPGKKARKNAQPSPARAPAELEVECATQLRRFGDKLNFRQKLLNLISKLFCSGT

SEQ ID NO: 1798 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 1799 - protein, 132 aa, Homo sapiens
  misc_feature (1)..(1): Xaa can be any naturally occurring amino acid
XPGAPPLPPGAQTRPRPRGVGETTLAMWPGLAGLSRSGSERKQLCTATQDTVCRCRAGTQPLDSYKPGVDCAPCPPGHFSPGDNQACKPWTNCTLAGKHTLQPASNSSDAICEDRDPPATQPQETQGPPARP

SEQ ID NO: 1800 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1801 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 1802 - protein, 133 aa, Homo sapiens; identical to SEQ ID NO: 1801

SEQ ID NO: 1803 - protein, 393 aa, Homo sapiens [sequence omitted]

SEQ ID NO: 1804 - protein, 393 aa, Homo sapiens [sequence omitted]

SEQ ID NO: 1805 - protein, 343 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQKTFPARHGGSHL

SEQ ID NO: 1806 - protein, 382 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 1807 - protein, 285 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSRPRQVDHLRSGVQDSLANIAKSHLY

SEQ ID NO: 1808 - protein, 90 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVSGRRG

SEQ ID NO: 1809 - protein, 44 aa, Homo sapiens
PLPSQRRNHWMENISPFSHLKSKKGQSTSRHKKLMFKTEGPDSD

SEQ ID NO: 1810 - protein, 341 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 1811 - protein, 393 aa, Homo sapiens [sequence omitted]

SEQ ID NO: 1812 - protein, 346 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 1813 - protein, 128 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSP

SEQ ID NO: 1814 - protein, 165 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQ

SEQ ID NO: 1815 - protein, 199 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQ

SEQ ID NO: 1816 - protein, 155 aa, Homo sapiens
MEEPQSDPSVEPPLSQETFSDLWKLLPENNVLYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNR

SEQ ID NO: 1817 - protein, 155 aa, Homo sapiens; identical to SEQ ID NO: 1816

SEQ ID NO: 1818 - protein, 525 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 1819 - protein, 472 aa, Homo sapiens
MDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 1820 - protein, 451 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSTAMC

SEQ ID NO: 1821 - protein, 502 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 1822 - protein, 482 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRAPVSPLKFSPFEGFRPSPSLPEPTELPLPPLLPPPPPSTTAPLPIRPPSGTKKSKRGRGRPGR

SEQ ID NO: 1823 - protein, 154 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSVD

SEQ ID NO: 1824 - protein, 154 aa, Homo sapiens; identical to SEQ ID NO: 1823

SEQ ID NO: 1825 - protein, 643 aa, Homo sapiens
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 1826 - protein, 228 aa, Homo sapiens
MPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 1827 - protein, 735 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 1828 - protein, 166 aa, Homo sapiens
AQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 1829 - protein, 719 aa, Homo sapiens
MQTPADFPRVERDLVPCPRKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 1830 - protein, 744 aa, Homo sapiens
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 1831 - protein, 524 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 1832 - protein, 155 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGVYILGQHGHSAPTLKLPGGPRLREQSKPPPACPLPHVQIKRMVPMLFQQHLLDSASSVA

SEQ ID NO: 1833 - protein, 108 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTEPPIPCGIEVMGR

SEQ ID NO: 1834 - protein, 108 aa, Homo sapiens; identical to SEQ ID NO: 1833

SEQ ID NO: 1835 - protein, 1014 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 1836 - protein, 250 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKKKKKKKKKERKKKKKKRKKK

SEQ ID NO: 1837 - protein, 556 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 1838 - protein, 532 aa, Homo sapiens
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQGVSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 1839 - protein, 492 aa, Homo sapiens
RAQDEGGHCWGSASGRRTLRRRRAAQRCGGGARADAGPMARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPCLTGRII

SEQ ID NO: 1840 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 1841 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 1842 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 1843 - protein, 1068 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQDALPAVSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 1844 - protein, 1068 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 1845 - protein, 1044 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 1846 - protein, 1102 aa, Homo sapiens; identical to SEQ ID NO: 1842

SEQ ID NO: 1847 - protein, 100 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLC

SEQ ID NO: 1848 - protein, 118 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIG

SEQ ID NO: 1849 - protein, 1070 aa, Homo sapiens; identical to SEQ ID NO: 1841

SEQ ID NO: 1850 - protein, 131 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIG

SEQ ID NO: 1851 - protein, 702 aa, Homo sapiens
  misc_feature (1)..(1): Xaa can be any naturally occurring amino acid
XVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 1852 - protein, 1102 aa, Homo sapiens; identical to SEQ ID NO: 1842

SEQ ID NO: 1853 - protein, 1068 aa, Homo sapiens; identical to SEQ ID NO: 1844

SEQ ID NO: 1854 - protein, 319 aa, Homo sapiens
MIPESSELVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLR

SEQ ID NO: 1855 - protein, 521 aa, Homo sapiens
MDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDVCFPLDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 1856 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 1857 - protein, 343 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 1858 - protein, 357 aa, Homo sapiens
MGLSRKSSDASACSSSEISDFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1859 - protein, 264 aa, Homo sapiens
MSARKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKQNF

SEQ ID NO: 1860 - protein, 313 aa, Homo sapiens
MPDLKILKGKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1861 - protein, 355 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1862 - protein, 245 aa, Homo sapiens
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 1863 - protein, 398 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1864 - protein, 257 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 1865 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1866 - protein, 351 aa, Homo sapiens
MGNAPAKKDTEQEESVNEFLAKARGDFLYRWGNPAQNTASSDQFERLRTLGMGSFGRVMLVRHQETGGHYAMKILNKQKVVKMKQVEHILNEKRILQAIDFPFLVKLQFSFKDNSYLYLVMEYVPGGEMFSRLQRVGRFSEPHACFYAAQVVLAVQYLHSLDLIHRDLKPENLLIDQQGYLQVTDFGFAKRVKGRTWTLCGTPEYLAPEIILSKGYNKAVDWWALGVLIYEMAVGFPPFYADQPIQIYEKIVSGRVRFPSKLSSDLKHLLRSLLQVDLTKRFGNLRNGVGDIKNHKWFATTSWIAIYEKKVEAPFIPKYTGPGDASNFDDYEEEELRISINEKCAKEFSEF

SEQ ID NO: 1867 - protein, 358 aa, Homo sapiens
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1868 - protein, 321 aa, Homo sapiens
MSARKSSDASACSSSEISVKEFLAKAKEDFLKKWENPTQNNAGLEDFERKKTLGTGSFGRVMLVKHKATEQYYAMKILDKQKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 1869 - protein, 209 aa, Homo sapiens
MSACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSK

SEQ ID NO: 1870 - protein, 197 aa, Homo sapiens
MSVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEI

SEQ ID NO: 1871 - protein, 214 aa, Homo sapiens
MGLSCSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNK

SEQ ID NO: 1872 - protein, 186 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQ

SEQ ID NO: 1873 - protein, 175 aa, Homo sapiens
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDL

SEQ ID NO: 1874 - protein, 206 aa, Homo sapiens
MSARKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTP

SEQ ID NO: 1875 - protein, 351 aa, Homo sapiens; identical to SEQ ID NO: 1856

SEQ ID NO: 1876 - protein, 230 aa, Homo sapiens
MLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRSGCGDTALEETDRSLLTHPIPWGALLVVRII

SEQ ID NO: 1877 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 1878 - protein, 676 aa, Homo sapiens; identical to SEQ ID NO: 1877

SEQ ID NO: 1879 - protein, 77 aa, Homo sapiens
MAPFLRIAFNSYELGSLQAEDEANQPFCAVKMKEALSTERGKTLVQKKPTMYPEWKSTFDAHIYEGRVIQIVLMRAA

SEQ ID NO: 1880 - protein, 125 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDV

SEQ ID NO: 1881 - protein, 592 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 1882 - protein, 409 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 1883 - protein, 409 aa, Homo sapiens; identical to SEQ ID NO: 1882

SEQ ID NO: 1884 - protein, 488 aa, Homo sapiens
MLTPRTDESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 1885 - protein, 82 aa, Homo sapiens
MDSVMPSQEPPVDDKNEDADLPSEETDGIAYISSSRKHDSIKDDSEDLKPVIDGMDGIKISQGLGLQDFDLIRVIGRGSYAK

SEQ ID NO: 1886 - protein, 98 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMK

SEQ ID NO: 1887 - protein, 109 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDE

SEQ ID NO: 1888 - protein, 73 aa, Homo sapiens
MDSVMPSQEPPVDDKNEDADLPSEETDGIAYISSSRKHDSIKDDSEDLKPVIDGMDGIKISQGLGLQDFDLIR

SEQ ID NO: 1889 - protein, 71 aa, Homo sapiens
MDSVMPSQEPPVDDKNEDADLPSEETDGIAYISSSRKHDSIKDDSEDLKPVIDGMDGIKISQGLGLQDFDL

SEQ ID NO: 1890 - protein, 341 aa, Homo sapiens
MSDSEKLNLDSIIGRLLEGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 1891 - protein, 330 aa, Homo sapiens
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 1892 - protein, 414 aa, Homo sapiens
MRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPGTAGWGTSATGAVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGR

SEQ ID NO: 1893 - protein, 309 aa, Homo sapiens
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 1894 - protein, 514 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 1895 - protein, 454 aa, Homo sapiens
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 1896 - protein, 479 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 1897 - protein, 372 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 1898 - protein, 270 aa, Homo sapiens
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRYCSCWGPAWAWVGASSKPK

SEQ ID NO: 1899 - protein, 605 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 1900 - protein, 755 aa, Homo sapiens
MAGCIPEEKTYRRFLELFLGEFRGPCGGGEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 1901 - protein, 505 aa, Homo sapiens
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 1902 - protein, 233 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADENCAWSAALDLEPVDTICGASVEREICLILSQVKESSGSYPGLREGSHISLSH

SEQ ID NO: 1903 - protein, 298 aa, Homo sapiens
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 1904 - protein, 340 aa, Homo sapiens
MEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKVLGAWRGTFGAWCSRGREPRGFGEEGFDREARVKLAKEGIGLKRRAWPEVGRAKIQGRSLRDALRHGRVSGRDLRERAWSFGKGRFWVVGAGPEVLISAGRWKSR

SEQ ID NO: 1905 - protein, 455 aa, Homo sapiens
MFCSGRKWVAEATICTKLMKREKRRMGKRRAKKAKREEKKKGGERRRNEKRGNQMKRMCERKKYETDLEDQDIMGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 1906 - protein, 324 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEGGSFNKK

SEQ ID NO: 1907 - protein, 546 aa, Homo sapiens
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 1908 - protein, 192 aa, Homo sapiens
MSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 1909 - protein, 546 aa, Homo sapiens; identical to SEQ ID NO: 1907

SEQ ID NO: 1910 - protein, 299 aa, Homo sapiens
MASRLLHRHIREQLKDLKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 1911 - protein, 387 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGGAGDLEDPW

SEQ ID NO: 1912 - protein, 430 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKDFGFELDSRK

SEQ ID NO: 1913 - protein, 382 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 1914 - protein, 347 aa, Homo sapiens
FSLFPAVDNEEAALLHEEATMTIEELLTRYGQNCHKGPPHSKSGASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 1915 - protein, 430 aa, Homo sapiens
MAVLARQLQRLLWTACKKKEREKEGREEEEEEEAGRRAPEGPRSLLTAPRRAQRPHGGAEASGGLRFGASAAQGWRARMEDAHCTWLSLPGLPPGWALFAVLDGHGGARAARFGARHLPGHVLQELGPEPSEPEGVREALRRAFLSADERLRSLWPRVETGGCTAVVLLVSPRFLYLAHCGDSRAVLSRAGAVAFSTEDHRPLRPRERERIHAAGGTIRRRRVEGSLAVSRALGDFTYKEAPGRPPELQLVSAEPEVAALARQAEDEFMLLASDGVWDTVSGAALAGLVASRLRLGLAPELLCAQLLDTCLCKGSLDNMTCILVCFPGAPRPSEEAIRRELALDAALGCRIAELCASAQKPPSLNTVFRTLASEDIPDLPPGGGLDCKATVIAEVYSQICQVSEECGEKGQDGAGKSNPTHLGSALDMEA

SEQ ID NO: 1916 - protein, 361 aa, Homo sapiens
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGESQRGRPKWEKVSRKPRPRVWPAAHQGFREAV

SEQ ID NO: 1917 - protein, 286 aa, Homo sapiens
MEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 1918 - protein, 286 aa, Homo sapiens; identical to SEQ ID NO: 1917

SEQ ID NO: 1919 - protein, 380 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGQK

SEQ ID NO: 1920 - protein, 247 aa, Homo sapiens
MGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 1921 - protein, 327 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEGKTNAF

SEQ ID NO: 1922 - protein, 378 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDG

SEQ ID NO: 1923 - protein, 606 aa, Homo sapiens
LRQCYNYNCPSFLAAALARATSDEVLQSDLSAHYIPKETDGTEGTVEIETVKLARSVFSKLHEICCSWVKDFPLRRRPQLYYETSIHAIKNMRKLFYKHISKKKKKRKKRDWDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 1924 - protein, 459 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 1925 - protein, 194 aa, Homo sapiens
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAVTF

SEQ ID NO: 1926 - protein, 360 aa, Homo sapiens
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 1927 - protein, 233 aa, Homo sapiens; identical to SEQ ID NO: 1902

SEQ ID NO: 1928 - protein, 187 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRV

SEQ ID NO: 1929 - protein, 129 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTA

SEQ ID NO: 1930 - protein, 382 aa, Homo sapiens; identical to SEQ ID NO: 1913

SEQ ID NO: 1931 - protein, 148 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSR

SEQ ID NO: 1932 - protein, 350 aa, Homo sapiens
MGLCPSTRETAPPAVLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 1933 - protein, 529 aa, Homo sapiens
MGAYLSQPNTVKCSGDGVGVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 1934 - protein, 278 aa, Homo sapiens
MWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKDFGFELDSRK

SEQ ID NO: 1935 - protein, 101 aa, Homo sapiens
MKFGMGSAQACPCQVPRAASTTWVPCQICETRGAAAAPPLTLEGPVQSHHGTPALTQGPQSPRDGAQLGACTRPVDVRDSGGRPLPPPDTLASAGDFLCTM

SEQ ID NO: 1936 - protein, 131 aa, Homo sapiens
MKFGMGSAQACPCQVPRAASTTWVPCQICGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 1937 - protein, 193 aa, Homo sapiens
MARARQEGSSPEPVEGLARDGPRPFPLGRLVPSAVSCGLCEPGLAAAPAAPTLLPAAYLCAPTAPPAVTAALGGSRWPGGPRSRPRGPRPDGPQPSLSLAEQHLESPVPSAPGALAGGPTQAAPGVRGEEEQWAREIGAQLRRMADDLNAQYERRRQEEQQRHRPSPWRVLYNLIMGLLPLPRGHRAPEMEPN

SEQ ID NO: 1938 - protein, 261 aa, Homo sapiens
MKFGMGSAQACPCQVPRAASTTWVPCQICGPRERHGPRTPGGQLPGARRGPGPRRPAPLPARPPGALGSVLRPLRARPGCRPRRPHPAARCLPLRPHRPTRRHRRPGGFPLAWGSPQPAPRPAPGRSSALALAGGAAPGVARAQRPGGSGGRSHPGGPGSPRGGGTVGPGDRGPAAADGGRPQRTVRAAETRGAAAAPPLTLEGPVQSHHGTPALTQGPQSPRDGAQLGACTRPVDVRDSGGRPLPPPDTLASAGDFLCTM

SEQ ID NO: 1939 - protein, 199 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGDRLTGIPSHILNSSPSDRQINQLAQRLGPEWEPMVLSLGLSQTDIYRCKANHPHNVQSQVVEAFIRWRQRFGKQATFQSLHNGLRAVEVDPSLLLHMLE

SEQ ID NO: 1940 - protein, 121 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAEMRKLRPKDSVTCLASQLTWRF

SEQ ID NO: 1941 - protein, 199 aa, Homo sapiens; identical to SEQ ID NO: 1939

SEQ ID NO: 1942 - protein, 103 aa, Homo sapiens
MEARDKQVLRSLRLELGAEVLVEGLVLQYLYQEGILTENHIQEINAQTTGLRKTMLLLDILPSRGPKAFDTFLDSLQEFPWVREKLKKAREEAMTDLPAGCWP

SEQ ID NO: 1943 - protein, 616 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 1944 - protein, 321 aa, Homo sapiens
GSRARWATEAAEAAAPASLSRAMAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 1945 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 1946 - protein, 244 aa, Homo sapiens
MDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 1947 - protein, 244 aa, Homo sapiens; identical to SEQ ID NO: 1946

SEQ ID NO: 1948 - protein, 244 aa, Homo sapiens; identical to SEQ ID NO: 1946

SEQ ID NO: 1949 - protein, 244 aa, Homo sapiens; identical to SEQ ID NO: 1946

SEQ ID NO: 1950 - protein, 548 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 1951 - protein, 551 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 1952 - protein, 246 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVCPQASTPALSLYVIPEHHQL

SEQ ID NO: 1953 - protein, 377 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPGKDFLLSHWNDRFSSVQLRSSGDEDSWAPLQTY

SEQ ID NO: 1954 - protein, 237 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKAHGIPVPARYRRSSPD

SEQ ID NO: 1955 - protein, 425 aa, Homo sapiens [sequence omitted]

SEQ ID NO: 1956 - protein, 671 aa, Homo sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 1957 - protein, 671 aa, Homo sapiens; identical to SEQ ID NO: 1956

SEQ ID NO: 1958 - protein, 273 aa, Homo sapiens
MSPACRVNSKTKPTTIFMAAAWTGRRNSSPDRMWLTTERRKGDAGSPMTLLHRPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 1959 - protein, 625 aa, Homo sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 1960 - protein, 356 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 1961 - protein, 356 aa, Homo sapiens; identical to SEQ ID NO: 1960

SEQ ID NO: 1962 - protein, 440 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 1963 - protein, 356 aa, Homo sapiens; identical to SEQ ID NO: 1960

SEQ ID NO: 1964 - protein, 140 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAES

SEQ ID NO: 1965 - protein, 296 aa, Homo sapiens
MTSSESTLKRKKSAGGTTAHRVLRRRPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 1966 - protein, 167 aa, Homo sapiens
MAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPL

SEQ ID NO: 1967 - protein, 582 aa, Homo sapiens
MTQGPGGRAPPAPPAPPEPEAPTTFCALLPRMPQWKFAAPGGFLGRGPAAARAAGASGGADPQPEPAGPGGVPALAAAVLGACEPRCAAPCPLPALSRCRGAGSRGSRGGRGAAGSGDAAAAAEWIRKGSFIHKPAHGWLHPDARVLGPGVSYVVRYMGCIEVLRSMRSLDFNTRTQVTREAINRLHEAVPGVRGSWKKKAPNKALASVLGKSNLRFAGMSISIHISTDGLSLSVPATRQVIANHHMPSISFASGGDTDMTDYVAYVAKDPINQRACHILECCEGLAQSIISTVGQAFELRFKQYLHSPPKVALPPERLAGPEESAWGDEEDSLEHNYYNSIPGKEPPLGGLVDSRLALTQPCALTALDQGPSPSLRDACSLPWDVGSTGTAPPGDGYVQADARGPPDHEEHLYVNTQGLDAPEPEDSPKKDLFDMRPFEDALKLHECSVAAGVTAAPLPLEDQWPSPPTRRAPVAPTEEQLRQEPWYHGRMSRRAAERMLRADGDFLVRDSVTNPGQYVLTGMHAGQPKHLLLVDPEGVVRTKDVLFESISHLIDHHLQNGQPIVAAESELHLRGVVSREP

SEQ ID NO: 1968 - protein, 137 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAAD

SEQ ID NO: 1969 - protein, 305 aa, Homo sapiens
MAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVRWGFAMLPKLFLNSRAQVIRLPRPPRVLGLQARTTMPSLHIFFCTVYTLLRHANFLQVKKGVYSSQLHSFRADVAFAFSHFTDLSIPTTVSF

SEQ ID NO: 1970 - protein, 520 aa, Homo sapiens
MSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1971 - protein, 583 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1972 - protein, 384 aa, Homo sapiens
MDLLPPKPKYNPLRNESLSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1973 - protein, 473 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1974 - protein, 474 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1975 - protein, 105 aa, Homo sapiens
MKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTRSNSY

SEQ ID NO: 1976 - protein, 105 aa, Homo sapiens; identical to SEQ ID NO: 1975

SEQ ID NO: 1977 - protein, 594 aa, Homo sapiens
MLPRTKYNRFRNDSVTSVDDLLHSLSVSGGGGKVSAARATPAAAPYLVSGEALRKAPDDGPGSLGHLLHKVSHLKLSSSGLRGLSSAARERAGARLSGSCSAPSLAAPDGSAPSAPRAPAMSAARKGRPGDEPLPRPPRGAPHASDQVLGPGVTYVVKYLGCIEVLRSMRSLDFSTRTQITREAISRVCEAVPGAKGAFKKRKPPSKMLSSILGKSNLQFAGMSISLTISTASLNLRTPDSKQIIANHHMRSISFASGGDPDTTDYVAYVAKDPVNRRACHILECCDGLAQDVIGSIGQAFELRFKQYLQCPTKIPALHDRMQSLDEPWTEEEGDGSDHPYYNSIPSKMPPPGGFLDTRLKPRPHAPDTAQFAGKEQTYYQGRHLGDTFGEDWQQTPLRQGSSDIYSTPEGKLHVAPTGEAPTYVNTQQIPPQAWPAAVSSAESSPRKDLFDMKPFEDALKNQPLGPVLSKAASVECISPVSPRAPDAKMLEELQAETWYQGEMSRKEAEGLLEKDGDFLVRKSTTNPGSFVLTGMHNGQAKHLLLVDPEGTIRTKDRVFDSISHLINHHLESSLPIVSAGSELCLQQPVERKQ

SEQ ID NO: 1978 - protein, 200 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQDTAEYVAYVAKDPVNQRACHILECPEGLAQDVISTIGQAFELRFKQYLRNPPKLVTPHDR

SEQ ID NO: 1979 - protein, 200 aa, Homo sapiens
MPITLTVSTSSLNLMAADCKQDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPP

SEQ ID NO: 1980 - protein, 130 aa, Homo sapiens
MPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPP

SEQ ID NO: 1981 - protein, 297 aa, Homo sapiens
  misc_feature (1)..(1): Xaa can be any naturally occurring amino acid
XDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVRWGFAMLPKLFLNSRAQVIRLPRPPRVLGLQARTTMPSLHIFFCTVYTLLRHANFLQVKKGVYSSQLHSFRADVAFAFSHFTDLSIPTTVSF

SEQ ID NO: 1982 - protein, 584 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 1983 - protein, 313 aa, Homo sapiens
MTGKATPPSLYSWRGVLFTCLPAARTRKRKEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 1984 - protein, 298 aa, Homo sapiens
MVIIIFLLPPYVFISEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 1985 - protein, 282 aa, Homo sapiens
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 1986 - protein, 239 aa, Homo sapiens
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 1987 - protein, 186 aa, Homo sapiens
MKSDFYFQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 1988 - protein, 195 aa, Homo sapiens
MAALKSWLSRSVTSFFRYRQCLCVPVVANFKKRCFSELIRPWHKTVTIGFGVTLCAVPIAQAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 1989 - protein, 195 aa, Homo sapiens; identical to SEQ ID NO: 1988

SEQ ID NO: 1990 - protein, 239 aa, Homo sapiens; identical to SEQ ID NO: 1986

SEQ ID NO: 1991 - protein, 186 aa, Homo sapiens; identical to SEQ ID NO: 1987

SEQ ID NO: 1992 - protein, 457 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQEQPPYPSYNSNYWNSTARSRAPYPSTYPVRPELQGQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 1993 - protein, 421 aa, Homo sapiens
MSALRRSGYGPSDGPSYGRYYGPGGGDVPVHPPPPLYPLRPEPPQPPISWRVRGGGPAETTWLGEGGGGDGYYPSGGAWPEPGRAGGSHQSLNSYTNGAYGPTYPPGPGANTASYSGAYYAPGYTQTSYSTEVPSTYRSSGNSPTPVSRWIYPQQDCQTEAPPLRGQVPGYPPSQNPGMTLPHYPYGDGNRSVPQSGPTVRPQEDAWASPGAYGMGGRYPWPSSAPSAPPGNLYMTESTSPWPSSGSPQSPPSPPVQQPKDSSYPYSQSDQSMNRHNFPCSVHQYESSGTVNNDDSDLLDSQVQYSAEPQLYGNATSDHPNNQDQSSSLPEECVPSDESTPPSIKKIIHVLEKVQYLEQEVEEFVGKKTDKAYWLLEEMLTKELLELDSVETGGQDSVRQARKEAVCKIQAILEKLEKKGL

SEQ ID NO: 1994 - protein, 1332 aa, Homo sapiens [sequence omitted]

SEQ ID NO: 1995 - protein, 1104 aa, Homo sapiens
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPNTVNTSACFWCFQYHRCLQCI

SEQ ID NO: 1996 - protein, 1318 aa, Homo sapiens
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 1997 - protein, 1333 aa, Homo sapiens [sequence omitted]

SEQ ID NO: 1998 - protein, 1333 aa, Homo sapiens [sequence omitted]

SEQ ID NO: 1999 - protein, 314 aa, Homo sapiens
MLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKFPFGDLSRLRDSV

SEQ ID NO: 2000 - protein, 1299 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 2001 - protein, 1050 aa, Homo sapiens
MTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 2002 - protein, 76 aa, Homo sapiens
MSDQDSSEIHFKVKMTTHLKKLKESYCQRQGVPMNSLRFLFEGQRIADNHTPKELGMEEEDVIEVYQEQTGGHSTV

SEQ ID NO: 2003 - protein, 101 aa, Homo sapiens
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 2004 - protein, 101 aa, Homo sapiens; identical to SEQ ID NO: 2003

SEQ ID NO: 2005 - protein, 62 aa, Homo sapiens
MTTHLKKLKESYCQRQGVPMNSLRFLFEGQRIADNHTPKELGMEEEDVIEVYQEQTGGHSTV

SEQ ID NO: 2006 - protein, 62 aa, Homo sapiens; identical to SEQ ID NO: 2005

SEQ ID NO: 2007 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 2008 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 2009 - protein, 137 aa, Homo sapiens
MGAPTLPPAWQPFLKDHRISTFKNWPFLEGCACTPERMAEAGFIHCPTENEPDLAQCFFCFKELEGWEPDDDPMQRKPTIRRKNLRKLRRKCAVPSSSWLPWIEASGRSCLVPEWLHHFQGLFPGATSLPVGPLAMS

SEQ ID NO: 2010 - protein, 143 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIERALLAE

SEQ ID NO: 2011 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 2012 - protein, 248 aa, Homo sapiens
MSGLGRSRRGGRSRVDQEERWSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRKTKPPPVLTAGNCGVHRPPPETSTGSPRGQRLLWTQ

SEQ ID NO: 2013 - protein, 136 aa, Homo sapiens
DGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 2014 - protein, 174 aa, Homo sapiens
MRHFLSKVYSFPMRKLILFLVFPVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 2015 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 2016 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2017 - protein, 233 aa, Homo sapiens; identical to SEQ ID NO: 2016

SEQ ID NO: 2018 - protein, 233 aa, Homo sapiens; identical to SEQ ID NO: 2016

SEQ ID NO: 2019 - protein, 233 aa, Homo sapiens; identical to SEQ ID NO: 2016

SEQ ID NO: 2020 - protein, 233 aa, Homo sapiens; identical to SEQ ID NO: 2016

SEQ ID NO: 2021 - protein, 171 aa, Homo sapiens
FPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 2022 - protein, 233 aa, Homo sapiens; identical to SEQ ID NO: 2016

SEQ ID NO: 2023 - protein, 233 aa, Homo sapiens; identical to SEQ ID NO: 2016

SEQ ID NO: 2024 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 2025 - protein, 218 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 2026 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 2027 - protein, 461 aa, Homo sapiens; identical to SEQ ID NO: 2026

SEQ ID NO: 2028 - protein, 268 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVVSLSSS

SEQ ID NO: 2029 - protein, 155 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLS

SEQ ID NO: 2030 - protein, 312 aa, Homo sapiens
MAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 2031 - protein, 501 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 2032 - protein, 553 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMVTEAPAVGSRPRSPSSYDLVLHVPLTGAEACLMSVEEETELLLRSCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 2033 - protein, 422 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMVTEAPAVGSRPRSPSSYDLVLHVPLTGAEACLMSVEEETELLLRSCHEGRCPLMLTECPACKGLVRLGEKERHLEHECPERSLSCRHCRAPCCGADVKRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 2034 - protein, 121 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEY

SEQ ID NO: 2035 - protein, 172 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCG

SEQ ID NO: 2036 - protein, 193 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCG

SEQ ID NO: 2037 - protein, 500 aa, Homo sapiens
VAGRALSSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 2038 - protein, 501 aa, Homo sapiens; identical to SEQ ID NO: 2031

SEQ ID NO: 2039 - protein, 543 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSEGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 2040 - protein, 543 aa, Homo sapiens; identical to SEQ ID NO: 2039

SEQ ID NO: 2041 - protein, 568 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 2042 - protein, 485 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 2043 - protein, 568 aa, Homo sapiens; identical to SEQ ID NO: 2041

SEQ ID NO: 2044 - protein, 94 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQES

SEQ ID NO: 2045 - protein, 557 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDHLQQCLFQPVQCSNEKCREPVLRKDLKEHLSASCQFRKEKCLYCKKDVVVINLQNHEENLCPEYPVFCPNNCAKIILKTEVDEHLAVCPEAEQDCPFKHYGCAVTDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 2046 - protein, 557 aa, Homo sapiens; identical to SEQ ID NO: 2045

SEQ ID NO: 2047 - protein, 557 aa, Homo sapiens; identical to SEQ ID NO: 2045

SEQ ID NO: 2048 - protein, 451 aa, Homo sapiens
MAYSEEHKGMPCGFIRQNSGNSISLDFEPSIEYQFVERLEERYKCAFCHSVLHNPHQTGCGHRFCQHCILSLRELNTVPICPVDKEVIKSQEVFKDNCCKREVLNLYVYCSNAPGCNAKVILGRYQDKRRNLQQHEHSALREHMRLVLEKNVQLEEQISDLHKSLEQKESKIQQLAETIKKLEKEFKQFAQLFGKNGSFLPNIQVFASHIDKSAWLEAQVHQLLQMVNQQQNKFDLRPLMEAVDTVKQKITLLENNDQRLAVLEEETNKHDTHINIHKAQLSKNEERFKLLEGTCYNGKLIWKVTDYKMKKREAVDGHTVSIFSQSFYTSRCGYRLCARAYLNGDGSGRGSHLSLYFVVMRGEFDSLLQWPFRQRVTLMLLDQSGKKNIMETFKPDPNSSSFKRPDGEMNIASGCPRFVAHSVLENAKNAYIKDDTLFLKVAVDLTDLEDL

SEQ ID NO: 2049 - protein, 522 aa, Homo sapiens
MSLLNCENSCGSSQSESDCCVAMASSCSAVTKDDSVGGTASTGNLSSSFMEEIQGYDVEFDPPLESKYECPICLMALREAVQTPCGHRFCKACIIKSIRDAGHKCPVDNEILLENQLFPDNFAKREILSLMVKCPNEGCLHKMELRHLEDHQAHCEFALMDCPQCQRPFQKFHINIHILKDCPRRQVSCDNCAASMAFEDKEIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 2050 - protein, 522 aa, Homo sapiens; identical to SEQ ID NO: 2049

SEQ ID NO: 2051 - protein, 790 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 2052 - protein, 760 aa, Homo sapiens
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 2053 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 2054 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 2055 - protein, 330 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQSSDALEAWENGERSRKRRAVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKL

SEQ ID NO: 2056 - protein, 283 aa, Homo sapiens
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 2057 - protein, 283 aa, Homo sapiens; identical to SEQ ID NO: 2056

SEQ ID NO: 2058 - protein, 283 aa, Homo sapiens; identical to SEQ ID NO: 2056

SEQ ID NO: 2059 - protein, 282 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAG

SEQ ID NO: 2060 - protein, 309 aa, Homo sapiens
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 2061 - protein, 294 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 2062 - protein, 195 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNV

SEQ ID NO: 2063 - protein, 109 aa, Homo sapiens
MSWCNELRLPALKQHSIGRGLESHITMCIPPSYADLGKAARDIFNKGFGFGLVKLDVKTKSCSGVEFSTSGSSNTDTGKVTGTLETKYKWCEYGLTFTEKWNTDNTLGT

SEQ ID NO: 2064 - protein, 204 aa, Homo sapiens
MATHGQTCARPMCIPPSYADLGKAARDIFNKGFGFGLVKLDVKTKSCSGVEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGS

SEQ ID NO: 2065 - protein, 255 aa, Homo sapiens
MLVIPATQEAEEFSTSGSSNTDTGKVTGTLETKYKWCEYGLTFTEKWNTDNTLGTEIAIEDQICQGLKLTFDTTFSPNTGKKSGKIKSSYKRECINLGCDVDFDFAGPAIHGSAVFGYEGWLAGYQMTFDSAKSKLTRNNFAVGYRTGDFQLHTNVNDGTEFGGSIYQKVCEDLDTSVNLAWTSGTNCTRFGIAAKYQLDPTASISAKVNNSSLIGVGYTQTLRPGVKLTLSALVDGKSINAGGHKVGLALELEA

SEQ ID NO: 2066 - protein, 294 aa, Homo sapiens; identical to SEQ ID NO: 2061

SEQ ID NO: 2067 - protein, 497 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 2068 - protein, 497 aa, Homo sapiens; identical to SEQ ID NO: 2067

SEQ ID NO: 2069 - protein, 156 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPR

SEQ ID NO: 2070 - protein, 497 aa, Homo sapiens; identical to SEQ ID NO: 2067

SEQ ID NO: 2071 - protein, 497 aa, Homo sapiens; identical to SEQ ID NO: 2067

SEQ ID NO: 2072 - protein, 3056 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQNTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 2073 - protein, 138 aa, Homo sapiens
MTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRKLTIFSQ

SEQ ID NO: 2074 - protein, 3056 aa, Homo sapiens; identical to SEQ ID NO: 2072

SEQ ID NO: 2075 - protein, 93 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKK

SEQ ID NO: 2076 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 2077 - protein, 2580 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEDRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 2078 - protein, 791 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 2079 - protein, 764 aa, Homo sapiens
MAGTSAPGSKRRSEPPAPRPGPPPGTGHPPSKRARGFSAAAAPDPDDPFGAHGDFTADDLEELDTLASQALSQCPAAARDVSSDHKVHRLLDGMSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 2080 - protein, 664 aa, Homo sapiens
MKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 2081 - protein, 698 aa, Homo sapiens
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIKQEEAQKSFVDSWRQRSNTQGSILINLLLKQPLIPGSSLSLCHLLSSSSESPAGTPLQPPGFGSTLAGMSGLRTTGSYDGSFSLSALREAQNLAFTGLNLVARNECSRDGDPAEGGRRAFPLCQLPGAVHFLPLVQFFIGLHCQALQDLAAAKRSGAPGDSPTHSSCVSSGVETNPEDSVCILEGFSVTALSILQHLVCHSGAVVSLLLSGVGADSAAGEGNRSLVHRLSDGDMTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQSPLPPVTGSNCQCNVEVVRALTVMLHRQWLTVRRAGGPPRTDQQRRTVRCLRDTVLLLHGLSQKDKLFMMHCVEVLHQFDQVMPGVSMLIRGLPDVTDCEEAALDDLCAAETDVEDPEVECG

SEQ ID NO: 2082 - protein, 196 aa, Homo sapiens
MSKNPSGKNRETVPIKDNFELEVLQAQYKELKEKMKVMEEEVLIKNGEIKILRDSLHQTESVLEEQRRSHFLLEQEKTQALSDKEKEFSKKLQSLQSELQFKDAEMNELRTKLQTSERANKLAAPSVSHVSPRKNPSVVIKPEACSPQFGKTSFPTKESFSANMSLPHPCQTESGYKPLVGREDSKPHSLRGDSIK

SEQ ID NO: 2083 - protein, 777 aa, Homo sapiens
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 2084 - protein, 567 aa, Homo sapiens
MWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREHCQSCLMDATSICGEPSNTIQRTTLLSSSLQVGARSSVESPSQTVT

SEQ ID NO: 2085 - protein, 1417 aa, Homo sapiens
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 2086 - protein, 1047 aa, Homo sapiens
MSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 2087 - protein, 519 aa, Homo sapiens
MNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRN

SEQ ID NO: 2088 - protein, 1567 aa, Homo sapiens
MNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2089 - protein, 1624 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2090 - protein, 680 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2091 - protein, 721 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2092 - protein, 1598 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKGVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2093 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2094 - protein, 712 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2095 - protein, 1884 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2096 - protein, 63 aa, Homo sapiens
MDLSALRVEEVQNVINAMQKILECPICLELIKEPVSTKCDHIFCKFCMLKLLNQKKGPSQCPL

SEQ ID NO: 2097 - protein, 63 aa, Homo sapiens; identical to SEQ ID NO: 2096

SEQ ID NO: 2098 - protein, 699 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTGCPPNCGCAARCLDRGQWLPCNWADV

SEQ ID NO: 2099 - protein, 649 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEE

SEQ ID NO: 2100 - protein, 1885 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2101 - protein, 222 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKK

SEQ ID NO: 2102 - protein, 622 aa, Homo sapiens
MDLSALRVEEVQNVINAMQKILECPICLELIKEPVSTKCDHIFCKSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSE

SEQ ID NO: 2103 - protein, 623 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 2104 - protein, 498 aa, Homo sapiens
ELLKIICAFQLDTGLEYANSYNFAKKENNSPEHLKDEVSIIQSMGYRNRAKRLLQSEPENPSLETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERK

SEQ ID NO: 2105 - protein, 98 aa, Homo sapiens
MDLSALRVEEVQNVINAMQKILECPICLELIKEPVSTKCDHIFCKSLQESTRFSQLVEELLKIICAFQLDTGLEYANSYNFAKKENNSPEHLKDEVSI

SEQ ID NO: 2106 - protein, 759 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2107 - protein, 59 aa, Homo sapiens
MDLSALRVEEVQNVINAMQKILECPICLELIKEPVSTKCDHIFCKVLLCCPSWSTVVRS

SEQ ID NO: 2108 - protein, 1816 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 2109 - protein, 572 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQS

SEQ ID NO: 2110 - protein, 473 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 2111 - protein, 177 aa, Homo sapiens
MNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPN

SEQ ID NO: 2112 - protein, 1130 aa, Homo sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 2113 - protein, 1149 aa, Homo sapiens
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 2114 - protein, 64 aa, Homo sapiens
MGQQPGKVLGDQRRPSLPALHFIKGAGKKESSRHGGPHCNVFVEQALQRPVASDFEPQGLSEAA

SEQ ID NO: 2115 - protein, 161 aa, Homo sapiens
GRPGRSRARGGGEGGWRGGGRAGRAGPEPGPRAGRGVPAPDCWRGKMLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNY

SEQ ID NO: 2116 - protein, 945 aa, Homo sapiens
LRLLREPLQHPGRVGSSSFNGGRRAHHHAPLSSPKAQQAHCLWCVPQLRQVGDGTHGHHHEAQGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 2117 - protein, 524 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENEAFEFKKPVRPVSRGCLHSHGLQEGKDLFTQRQNSAPARMLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 2118 - protein, 484 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKENLSSNERDSSEPGNFIPLFTPQSPVTATLSDEDDGFVDLLDGENLKNEEETPSCMASLWTAPLVMRTTNLDNRCKLFDSPSLCSSSTRSVLKRPERSQEESPPGSTKRRKSMSGASPKESTNPEKAHETLHQSLSLASSPKGTIENILDNDPRDLIGDFSKGYLFHTVAGKHQDLKYISPEIMASVLNGKFANLIKEFVIIDCRYPYEYEGGHIKGAVNLHMEEEVEDFLLKKPIVPTDGKRVIVVFHCEFSSERGPRMCRYVRERDRLGNEYPKLHYPELYVLKGGYKEFFMKCQSYCEPPSYRPMHHEDFKEDLKKFRTKSRTWAGEKSKREMYSRLKKL

SEQ ID NO: 2119 - protein, 143 aa, Homo sapiens
MELGPEPPHRRRLLFACSPPPASQPVVKALFGASAAGGLSPVTNLTVTMDQLQGLGSDYEQPLEVKNNSNLQRMGSSESTDSGFCLDSPGPLDSKENLENPMRRIHSLPQKLLGCSPALKRSHSDSLDHDIFQLIDPDENKEN

SEQ ID NO: 2120 - protein, 580 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 2121 - protein, 539 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 2122 - protein, 516 aa, Homo sapiens
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 2123 - protein, 489 aa, Homo sapiens
MHSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 2124 - protein, 566 aa, Homo sapiens
MEVPQPEPAPGSALSPAGVCGGAQRPGHLPGLLLGSHGLLGSPVRAAASSPVTTLTQTMHDLAGLGSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGRFSLTPAEGDTEEDDGFVDILESDLKDDDAVPPGMESLISAPLVKTLEKEEEKDLVMYSKCQRLFRSPSMPCSVIRPILKRLERPQDRDTPVQNKRRRSVTPPEEQQEAEEPKARVLRSKSLCHDEIENLLDSDHRELIGDYSKAFLLQTVDGKHQDLKYISPETMVALLTGKFSNIVDKFVIVDCRYPYEYEGGHIKTAVNLPLERDAESFLLKSPIAPCSLDKRVILIFHCEFSSERGPRMCRFIRERDRAVNDYPSLYYPEMYILKGGYKEFFPQHPNFCEPQDYRPMNHEAFKDELKTFRLKTRSWAGERSRRELCSRLQDQ

SEQ ID NO: 2125 - protein, 473 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 2126 - protein, 400 aa, Homo sapiens
MSTELFSSTREEGSSGSGPSFRSNQRKMLNLLLERDTSFTVCPDVPRTPVGKFLGDSANLSILSGSPGFFRTSGSAFSWDDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 2127 - protein, 443 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 2128 - protein, 430 aa, Homo sapiens
MSTELFSSTREEGSSGSGPSFRSNQRKMLNLLLERDTSFTVCPDVPRTPVGKFLGDSANLSILSGSPGFFRTSGSAFSWDAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 2129 - protein, 400 aa, Homo sapiens; identical to SEQ ID NO: 2126

SEQ ID NO: 2130 - protein, 249 aa, Homo sapiens
MSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQ

SEQ ID NO: 2131 - protein, 473 aa, Homo sapiens; identical to SEQ ID NO: 2125

SEQ ID NO: 2132 - protein, 490 aa, Homo sapiens
MSEEARFCFSPGENSKTMSTELFSSTREEGSSGSGPSFRSNQRKMLNLLLERDTSFTVCPDVPRTPVGKFLGDSANLSILSGGTPKRCLDLSNLSSGEITATQLTTSADLDETGHLDSSGLQEVHLAGMNHDQHLMKCSPAQLLCSTPNGLDRGHRKRDAMCSSSANKENDNGNLVDSEMKYLGSPITTVPKLDKNPNLGEDQAEEISDELMEFSLKDQEAKVSRSGLYRSPSMPENLNRPRLKQVEKFKDNTIPDKVKKKYFSGQGKLRKGLCLKKTVSLCDITITQMLEEDSNQGHLIGDFSKVCALPTVSGKHQDLKYVNPETVAALLSGKFQGLIEKFYVIDCRYPYEYLGGHIQGALNLYSQEELFNFFLKKPIVPLDTQKRIIIVFHCEFSSERGPRMCRCLREEDRSLNQYPALYYPELYILKGGYRDFFPEYMELCEPQSYCPMHHQDHKTELLRCRSQSKVQEGERQLREQIALLVKDMSP

SEQ ID NO: 2133 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 2134 - protein, 264 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 2135 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 2136 - protein, 111 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKRCFVESLSSVETLKPTSWAKSLT

SEQ ID NO: 2137 - protein, 183 aa, Homo sapiens
MRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 2138 - protein, 203 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCI

SEQ ID NO: 2139 - protein, 170 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMA

SEQ ID NO: 2140 - protein, 115 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAE

SEQ ID NO: 2141 - protein, 326 aa, Homo sapiens
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 2142 - protein, 326 aa, Homo sapiens; identical to SEQ ID NO: 2141

SEQ ID NO: 2143 - protein, 432 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQVTISTTDRRNNKLIFKVNLLEMDDKILVDFRLSKGDGLEFKRHFLKIKGKLIDIVSSQKIWLPAT

SEQ ID NO: 2144 - protein, 476 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQVTISTTDRRNNKLIFKVNLLEMDDKILVDFRLSKGDGLEFKRHFLKIKGKLIDIVSSQKIWLPAT

SEQ ID NO: 2145 - protein, 476 aa, Homo sapiens; identical to SEQ ID NO: 2144

SEQ ID NO: 2146 - protein, 476 aa, Homo sapiens; identical to SEQ ID NO: 2144

SEQ ID NO: 2147 - protein, 133 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKP

SEQ ID NO: 2148 - protein, 170 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGT

SEQ ID NO: 2149 - protein, 204 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAG

SEQ ID NO: 2150 - protein, 476 aa, Homo sapiens; identical to SEQ ID NO: 2144

SEQ ID NO: 2151 - protein, 127 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGIT

SEQ ID NO: 2152 - protein, 442 aa, Homo sapiens
MAVPFVEDWDLVQTLGEGAYGEVQLAVNRVTEEAVAVKIVDMKRAVDCPENIKKEICINKMLNHENVVKFYGHRREGNIQYLFLEYCSGGELFDRIEPDIGMPEPDAQRFFHQLMAGVVYLHGIGITHRDIKPENLLLDERDNLKISDFGLATVFRYNNRERLLNKMCGTLPYVAPELLKRREFHAEPVDVWSCGIVLTAMLAGELPWDQPSDSCQEYSDWKEKKTYLNPWKKIDSAPLALLHKILVENPSARITIPDIKKDRWYNKPLKKGAKRPRVTSGGVSESPSGFSKHIQSNLDFSPVNSASSEENVKYSSSQPEPRTGLSLWDTSPSYIDKLVQGISFSQPTCPDHMLLNSQLLGTPGSSQNPWQRLVKRMTRFFTKLDADKSYQCLKETCEKLGYQWKKSCMNQGDGLEFKRHFLKIKGKLIDIVSSQKIWLPAT

SEQ ID NO: 2153 - protein, 543 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2154 - protein, 514 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2155 - protein, 226 aa, Homo sapiens
MSRESDVEAQQSHGSSACSQPHGSVTQSQGSSSQSQGISSSSTSTMPNSSQSSHSSSGTLSSLETVSTQELYSIPPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2156 - protein, 163 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLGDEDMKRKFQDLLSEENESTALPQVLAQPSTSRKRPREGEAEGAETTKRPAVCAAVL

SEQ ID NO: 2157 - protein, 289 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHDGRGRAV

SEQ ID NO: 2158 - protein, 452 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2159 - protein, 586 aa, Homo sapiens
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLETESGHVTQSDLELLLSSDPPASASQSAGIRGVRHHPRPVCSLKCVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2160 - protein, 514 aa, Homo sapiens; identical to SEQ ID NO: 2154

SEQ ID NO: 2161 - protein, 452 aa, Homo sapiens; identical to SEQ ID NO: 2158

SEQ ID NO: 2162 - protein, 543 aa, Homo sapiens; identical to SEQ ID NO: 2153

SEQ ID NO: 2163 - protein, 543 aa, Homo sapiens; identical to SEQ ID NO: 2153

SEQ ID NO: 2164 - protein, 322 aa, Homo sapiens
MSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 2165 - protein, 1332 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQKIPEKDSDWLTWSGAPIPGFFRLSFDPHG

SEQ ID NO: 2166 - protein, 1339 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 2167 - protein, 1275 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRGEKLQVLKAKLQEAMKLRRFEERQKRQALFKLDNEDGFEEEEEEEEEMTDESEEDGEEKVEKEEKEEELEEEEEKEEEEEEEGNQETAEFLLSSEEIETKDEKEMDKENNDGSSEIGKAVGFLSVPKSLSSDSTLLLFKDSSSKMGYFPTEEKSETDENSGKQPSKLDEDDSCSLLTKESSHNSSFELIGSTIPSYQPCNRQTGRGTSFFPTAGGFRSPSPGLFRASLVSSASKSSGKLSEPSLPIEDSQDLYNASPEPKTLFLGAGDFQFCLEDDTQSQLLDADGFLNVRNHRNQYQALKPRLPLASMDENAMDANMDELLDLCTGKFTSQAEKHLPRKSDKKENMEELLNLCSGKFTSQDASTPASSELNKQEKESSMGDPMEEALALCSGSFPTDKEEEDEEEEFGDFRLVSNDNEFDSDEDEHSDSGNDLALEDHEDDDEEELLKRSEKLKRQMRLRKYLEDEAEVSGSDVGSEDEYDGEEIDEYEEDVIDEVLPSDEELQSQIKKIHMKTMLDDDKRQLRLYQERYLADGDLHSDGPGRMRKFRWKNIDDASQMDLFHRDSDDDQTEEQLDESEARWRKERIEREQWLRDMAQQGKITAEEEEEIGEDSQFMILAKKVTAKALQKNASRPMVIQESKSLLRNPFEAIRPGSAQQVKTGSLLNQPKAVLQKLAALSDHNPSAPRNSRNFVFHTLSPVKAEAAKESSKSQVKKRGPSFMTSPSPKHLKTDDSTSGLTRSIFKYLES

SEQ ID NO: 2168 - protein, 658 aa, Homo sapiens
MTGEVGSEVHLEINDPNVISQEEADSPSDSGQGSYETIGPLSEGDSDEEIFVSKKLKNRKVLQDSDSETEDTNASPEKTTYDSAEEENKENLYAGKNTKIKRIYKTVADSDESYMEKSLYQENLEAQVKPCLELSLQSGNSTDFTTDRKSSKKHIHDKEGTAGKAKVKSKRRLEKEERKMEKIRQLKKKETKNQEDDVEQPFNDSGCLLVDKDLFETGLEDENNSPLEDEESLESIRAAVKNKVKKHKKKEPSLESGVHSFEEGSELSKGTTRKERKAARLSKEALKQLHSETQRLIRESALNLPYHMPENKTIHDFFKRKPRPTCHGNAMALLKSSKYQSSHHKEIIDTANTTEMNSDHHSKGSEQTTGAENEVETNALPVVSKETQIITGSDESCRKDLVKNEELEIQEKQKQSDIRPSPGDSSVLQQESNFLGNNHSEECQVGGLVAFEPHALEGEGPQNPEETDEKVEEPEQQNKSSAVGPPEKVRRFTLDRLKQLGVDVSIKPRLGADEDSFVILEPETNRELEALKQRFWKHANPAAKPRAGQTVNVNVIVKDMGTDGKEELKADVVPVTLAPKKLDGASHTKPGEKLQVLKAKLQEAMKLRRFEERQKRQALFKLDNEDGFEEEEEEEEEMTDESEEDGEEKKKKKKKKKN

SEQ ID NO: 2169 - protein, 432 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIILEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 2170 - protein, 433 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 2171 - protein, 1395 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGKICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRSRLKPLVLQEITSGEKSLIMKPLSIKEKPSTEKESFSQEPSALQKKHTTQEEVSILKEPSSLLKSPTEESPFDEALAFTKKCTIEEAPPTKKPLILKRKHATQGTMSHLKKPLILQTTSGEKSLIKEPLPFKEEKVSLKKKCTTQEMMSICPELLDFQDMIGEDKNSFFMEPMSFRKNPTTEETVLTKTSLSLQEKKITQGKMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 2172 - protein, 398 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDWENPQLCSDYVKDIYQYLRQLEVLQSINPHFLDGRDINGRMRAILVDWLVQVHSKFRLLQETLYMCVGIMDRFLQVQPVSRKKLQLVGITALLLASKYEEMFSPNIEDFVYITDNAYTSSQIREMETLILKELKFELGRPLPLHFLRRASKAGEVDVEQHTLAKYLMELTLIDYDMVHYHPSKVAAAASCLSQKVLGQGKWNLKQQYYTGYTENEVLEVMQHMAKNVVKVNENLTKFIAIKNKYASSKLLKISMIPQLNSKAVKDLASPLIGRS

SEQ ID NO: 2173 - protein, 291 aa, Homo sapiens
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 2174 - protein, 291 aa, Homo sapiens; identical to SEQ ID NO: 2173

SEQ ID NO: 2175 - protein, 1395 aa, Homo sapiens; identical to SEQ ID NO: 2171

SEQ ID NO: 2176 - protein, 111 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLK

SEQ ID NO: 2177 - protein, 396 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTVKNKYATSKHAKISTLPQLNSALVQDLAKAVAKV

SEQ ID NO: 2178 - protein, 401 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMVSQ

SEQ ID NO: 2179 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 2180 - protein, 289 aa, Homo sapiens
MELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQQDEEVSSLTCDALTELLAKITNTDVDCLKACQEQIEAVLLNSLQQYRQDQRDGSKSEDELDQASTPTDVRDIDL

SEQ ID NO: 2181 - protein, 242 aa, Homo sapiens
MKSAGGSGRSLLPSPRVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 2182 - protein, 211 aa, Homo sapiens
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 2183 - protein, 292 aa, Homo sapiens
MELLCCEGTRHAPRAGPDPRLLGDQRVLQSLLRLEERYVPRASYFQCVQREIKPHMRKMLAYWMLEVCEEQRCEEEVFPLAMNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 2184 - protein, 220 aa, Homo sapiens
MELLCCEGTRHAPRAGPDPRLLGDQRVLQSLLRLEERYVPRASYFQCVQREIKPHMRKMLAYWMLEDWEVLVLGKLKWDLAAVIAHDFLAFILHRLSLPRDRQALVKKHAQTFLALCATDYTFAMYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 2185 - protein, 96 aa, Homo sapiens
MYPPSMIATGSIGAAVQGLGACSMSGDELTELLAGITGTEVDCLRACQEQIEAALRESLREASQTSSSPAPKAPRGSSSQGPSQTSTPTDVTAIHL

SEQ ID NO: 2186 - protein, 118 aa, Homo sapiens
MNYLDRYLSCVPTRKAQLQLLGAVCMLLASKLRETTPLTIEKLCIYTDHAVSPRQLRDWEVLVLGKLKWDLAAVIAHDFLAFILHRLSLPRDRQALVKKHAQTFLALCATDYTFAMYP

SEQ ID NO: 2187 - protein, 211 aa, Homo sapiens; identical to SEQ ID NO: 2182

SEQ ID NO: 2188 - protein, 161 aa, Homo sapiens
MEHQLLCCEVETIRRAYPDANLLNDRVLRAMLKAEETCAPSVSYFKCVQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 2189 - protein, 410 aa, Homo sapiens
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 2190 - protein, 404 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 2191 - protein, 367 aa, Homo sapiens
MPRERRERDAKERDTMKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVSLSLPEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 2192 - protein, 374 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLCMISSHV

SEQ ID NO: 2193 - protein, 395 aa, Homo sapiens
MKEDGGAEFSARSRKRKANVTVFLQDPDEEMAKIDRTARDQCGSQPWDNNAVCADPCSLIPTPDKEDDDRVYPNSTCKPRIIAPSRGSPLPVLSWANREEVWKIMLNKEKTYLRDQHFLEQHPLLQPKMRAILLDWLMEVCEVYKLHRETFYLAQDFFDRYMATQENVVKTLLQLIGISSLFIAAKLEEIYPPKLHQFAYVTDGACSGDEILTMELMIMKALKWRLSPLTIVSWLNVYMQVAYLNDLHEVLLPQYPQQIFIQIAELLDLCVLDVDCLEFPYGILAASALYHFSSSELMQKVSGYQWCDIENCVKWMVPFAMVIRETGSSKLKHFRGVADEDAHNIQTHRDSLDLLDKARAKKAMLSEQNRASPLPSGLLTPPQSGKKQSSGPEMA

SEQ ID NO: 2194 - protein, 404 aa, Homo sapiens; identical to SEQ ID NO: 2190

SEQ ID NO: 2195 - protein, 296 aa, Homo sapiens
MSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 2196 - protein, 4127 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 2197 - protein, 4096 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 2198 - protein, 347 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 2199 - protein, 249 aa, Homo sapiens
MNPSPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 2200 - protein, 437 aa, Homo sapiens
MALAGAPAGGPCAPALEALLGAGALRLLDSSQIVIISAAQDASAPPAPTGPAAPAAGPCDPDLLLFATPQAPRPTPSAPRPALGRPPVKRRLDLETDHQYLAESSGPARGRGRHPGKGVKSPGEKSRYETSLNLTTKRFLELLSHSADGVVDLNWAAEVLKVQKRRIYDITNVLEGIQLIAKKSKNHIQWLGSHTTVGVGGRLEGLTQDLRQLQESEQQLDHLMNICTTQLRLLSEDTDSQRLAYVTCQDLRSIADPAEQMVMVIKAPPETQLQAVDSSENFQISLKSKQGPIDVFLCPEETVGGISPGKTPSQEVTSEEENRATDSATIVSPPPSSPPSSLTTDPSQSLLSLEQEPLLSRMGSLRAPVDEDRLSPLVAADSLLEHVREDFSGLLPEEFISLSPPHEALDYHFGLEEGEGIRDLFDCDFGDLTPLDF

SEQ ID NO: 2201 - protein, 465 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 2202 - protein, 437 aa, Homo sapiens
MLQGPRALASAAGQTPKVVPAMSPTELWPSGLSSPQLCPATATYYTPLYPQTAPPAAAPGTCLDATPHGPEGQVVRCLPAGRLPAKRKLDLEGIGRPVVPEFPTPKGKCIRVDGLPSPKTPKSPGEKTRYDTSLGLLTKKFIYLLSESEDGVLDLNWAAEVLDVQKRRIYDITNVLEGIQLIRKKAKNNIQWVGRGMFEDPTRPGKQQQLGQELKELMNTEQALDQLIQSCSLSFKHLTEDKANKRLAYVTYQDIRAVGNFKEQTVIAVKAPPQTRLEVPDRTEDNLQIYLKSTQGPIEVYLCPEEVQEPDSPSEEPLPSTSTLCPSPDSAQPSSSTDPSIMEPTASSVPAPAPTPQQAPPPPSLVPLEATDSLLELPHPLLQQTEDQFLSPTLACSSPLISFSPSLDQDDYLWGLEAGEGISDLFDSYDLGDLLIN

SEQ ID NO: 2203 - protein, 133 aa, Homo sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWMTLSQCT

SEQ ID NO: 2204 - protein, 128 aa, Homo sapiens
MDKRALLASGGGGGPPAKRRLELGESGHQYLSDGLKTPKGKGRAALRSPDSPKKKTRYDTSLGLLTKKFIQLLSQSPDGVLDLNKAAEVLKVQKRRIYDITNVLEGISDLFDAYDLEKLPLVEDFMCS

SEQ ID NO: 2205 - protein, 413 aa, Homo sapiens
MAEAGPQAPPPPGTPSRHEKSLGLLTTKFVSLLQEAKDGVLDLKLAADTLAVRQKRRIYDITNVLEGIGLIEKKSKNSIQWKGVGPGCNTREIADKLIELKAEIEELQQREQELDQHKVWVQQSIRNVTEDVQNSCLAYVTHEDICRCFAGDTLLAIRAPSGTSLEVPIPEGLNGQKKYQIHLKSVSGPIEVLLVNKEAWSSPPVAVPVPPPEDLLQSPSAVSTPPPLPKPALAQSQEASRPNSPQLTPTAVPGSAEVQGMAGPAAEITVSGGPGTDSKDSGELSSLPLGPTTLDTRPLQSSALLDSSSSSSSSSSSSSNSNSSSSSGPNPSTSFEPIKADPTGVLELPKELSEIFDPTRECMSSELLEELMSSEVFAPLLRLSPPPGDHDYIYNLDESEGVCDLFDVPVLNL

SEQ ID NO: 2206 - protein, 281 aa, Homo sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 2207 - protein, 346 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 2208 - protein, 345 aa, Homo sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSGSISGDIIDELMSSDVFPLLRLSPTPADDYNFNLDDNEGVCDLFDVQILNY

SEQ ID NO: 2209 - protein, 185 aa, Homo sapiens
MDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 2210 - protein, 182 aa, Homo sapiens
SYDSTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 2211 - protein, 334 aa, Homo sapiens
MPLQQQAKRRLELGESGHQYLSDGLKTPKGKGRAALRSPDSPKKKTRYDTSLGLLTKKFIQLLSQSPDGVLDLNKAAEVLKVQKRRIYDITNVLEGIHLIKKKSKNNVQWMGCSLSEDGGMLAQCQGLSKEVTELSQEEKKLDELIQSCTLDLKLLTEDSENQRLAYVTYQDIRKISGLKDQTVIVVKAPPETRLEVPDSIESLQIHLASTQGPIEVYLCPEETETHSPMKTNNQDHNGNIPKPASKDLASTNSGHSDCSVSMGNLSPLASPANLLQQTEDQIPSNLEGPFVNLLPPLLQEDYLLSLGEEEGISDLFDAYDLEKLPLVEDFMCS

SEQ ID NO: 2212 - protein, 206 aa, Homo sapiens
MDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 2213 - protein, 206 aa, Homo sapiens; identical to SEQ ID NO: 2212

SEQ ID NO: 2214 - protein, 1471 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEVSLQNPPESGTDGCILLIVLSWWSRTLPTYVYCQMLLCPFPFPP

SEQ ID NO: 2215 - protein, 1249 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRFMKRNSSTGTWLFETSVSSST

SEQ ID NO: 2216 - protein, 1451 aa, Homo sapiens
MVSKRRLSKSEDKESLTEDASKTRKQPLSKKTKKSHIANEVEENDSIFVKLLKISGIILKTGESQNQLAVDQIAFQKKLFQTLRRHPSYPKIIEEFVSGLESYIEDEDSFRNCLLSCERLQDEEASMGASYSKSLIKLLLGIDILQPAIIKTLFEKLPEYFFENKNSDEINIPRLIVSQLKWLDRVVDGKDLTTKIMQLISIAPENLQHDIITSLPEILGDSQHADVGKELSDLLIENTSLTVPILDVLSSLRLDPNFLLKVRQLVMDKLSSIRLEDLPVIIKFILHSVTAMDTLEVISELREKLDLQHCVLPSRLQASQVKLKSKGRASSSGNQESSGQSCIILLFDVIKSAIRYEKTISEAWIKAIENTASVSEHKVFDLVMLFIIYSTNTQTKKYIDRVLRNKIRSGCIQEQLLQSTFSVHYLVLKDMCSSILSLAQSLLHSLDQSIISFGSLLYKYAFKFFDTYCQQEVVGALVTHICSGNEAEVDTALDVLLELVVLNPSAMMMNAVFVKGILDYLDNISPQQIRKLFYVLSTLAFSKQNEASSHIQDDMHLVIRKQLSSTVFKYKLIGIIGAVTMAGIMAADRSESPSLTQERANLSDEQCTQVTSLLQLVHSCSEQSPQASALYYDEFANLIQHEKLDPKALEWVGHTICNDFQDAFVVDSCVVPEGDFPFPVKALYGLEEYDTQDGIAINLLPLLFSQDFAKDGGPVTSQESGQKLVSPLCLAPYFRLLRLCVERQHNGNLEEIDGLLDCPIFLTDLEPGEKLESMSAKERSFMCSLIFLTLNWFREIVNAFCQETSPEMKGKVLTRLKHIVELQIILEKYLAVTPDYVPPLGNFDVETLDITPHTVTAISAKIRKKGKIERKQKTDGSKTSSSDTLSEEKNSECDPTPSHRGQLNKEFTGKEEKTSLLLHNSHAFFRELDIEVFSILHCGLVTKFILDTEMHTEATEVVQLGPPELLFLLEDLSQKLESMLTPPIARRVPFLKNKGSRNIGFSHLQQRSAQEIVHCVFQLLTPMCNHLENIHNYFQCLAAENHGVVDGPGVKVQEYHIMSSCYQRLLQIFHGLFAWSGFSQPENQNLLYSALHVLSSRLKQGEHSQPLEELLSQSVHYLQNFHQSIPSFQCALYLIRLLMVILEKSTASAQNKEKIASLARQFLCRVWPSGDKEKSNISNDQLHALLCIYLEHTESILKAIEEIAGVGVPELINSPKDASSSTFPTLTRHTFVVFFRVMMAELEKTVKKIEPGTAADSQQIHEEKLLYWNMAVRDFSILINLIKVFDSHPVLHVCLKYGRLFVEAFLKQCMPLLDFSFRKHREDVLSLLETFQLDTRLLHHLCGHSKIHQDTRLTQHVPLLKKTLELLVCRVKAMLTLNNCREAFWLGNLKNRDLQGEEIKSQNSQESTADESEDDMSSQASKSKATEDGEEDEVSAGEKEQDSDESYDDSD

SEQ ID NO: 2217 - protein, 1451 aa, Homo sapiens; identical to SEQ ID NO: 2216

SEQ ID NO: 2218 - protein, 375 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLGADHVVKPLGIKLSRNIHLWDPENSVLQNLKDVLEIDFPARAILEKSDFTMDCGICYAYQLDGTIPDQVCDNSQCGQPFHQICLYEWLRGLLTSRQSFNIIFGECPYCSKPITLKMSGRKH

SEQ ID NO: 2219 - protein, 127 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKAP

SEQ ID NO: 2220 - protein, 165 aa, Homo sapiens
MTLEEFSAGEQKTERMDKVGDALEEVLSKALSQRTITVGVYEAAKLLNVDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 2221 - protein, 160 aa, Homo sapiens
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTNPHTDAWKSHGLVEVASYCEESRGNNQWVPYISLQER

SEQ ID NO: 2222 - protein, 131 aa, Homo sapiens
MTLEEFSAGEQKTESDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 2223 - protein, 442 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2224 - protein, 436 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2225 - protein, 321 aa, Homo sapiens
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2226 - protein, 452 aa, Homo sapiens
MVRSRQMCNTNMSVPTDGAVTTSQIPASEQETLVRPKPLLLKLLKSVGAQKDTYTMKEKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2227 - protein, 256 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLLLGVYQVTVYQAGESDTDSFEEDPEISLAHYL

SEQ ID NO: 2228 - protein, 265 aa, Homo sapiens
MSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2229 - protein, 466 aa, Homo sapiens
MCNTNMSVPTDGAVTTSQIPASEQETLVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2230 - protein, 321 aa, Homo sapiens; identical to SEQ ID NO: 2225

SEQ ID NO: 2231 - protein, 159 aa, Homo sapiens
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCLKKRNKPCPVCRQPIQMIVLTYFP

SEQ ID NO: 2232 - protein, 296 aa, Homo sapiens
MCNTNMSVPTDGAVTTSQIPASEQETLDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2233 - protein, 243 aa, Homo sapiens
MCNTNMSVPTDGAVTTSQIPASEQETLVRPKPLLLKLLKSVGAQKDTYTMKEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2234 - protein, 218 aa, Homo sapiens
MCNTNMSVPTDGAVTTSQIPASEQETLDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2235 - protein, 218 aa, Homo sapiens; identical to SEQ ID NO: 2234

SEQ ID NO: 2236 - protein, 256 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVYQVTVYQAGESDTDSFEEDPEISLADYW

SEQ ID NO: 2237 - protein, 270 aa, Homo sapiens
MCNTNMSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2238 - protein, 497 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2239 - protein, 130 aa, Homo sapiens
MCNTNMSVPTDGAVTTSQIPASEQETLVRPKPLLLKLLKSVGAQKDTYTMKEFEREETQDKEESVESSLPLNAIEPCVICQGRPKNGCIVHGKTGHLMACFTCAKKLKKRNKPCPVCRQPIQMIVLTYFP

SEQ ID NO: 2240 - protein, 257 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSE

SEQ ID NO: 2241 - protein, 296 aa, Homo sapiens; identical to SEQ ID NO: 2232

SEQ ID NO: 2242 - protein, 446 aa, Homo sapiens
MCNTNMSVPTDGAVTTSQIPASEQETLVRPKPLLLKLLKSVGAQKDTYTMKEKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 2243 - protein, 1825 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2244 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2245 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2246 - protein, 162 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRL

SEQ ID NO: 2247 - protein, 113 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSH

SEQ ID NO: 2248 - protein, 127 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLL

SEQ ID NO: 2249 - protein, 162 aa, Homo sapiens; identical to SEQ ID NO: 2246

SEQ ID NO: 2250 - protein, 306 aa, Homo sapiens
  misc_feature (1)..(1): Xaa can be any naturally occurring amino acid
XHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVP

SEQ ID NO: 2251 - protein, 127 aa, Homo sapiens; identical to SEQ ID NO: 2248

SEQ ID NO: 2252 - protein, 306 aa, Homo sapiens; identical to SEQ ID NO: 2250
  misc_feature (1)..(1): Xaa can be any naturally occurring amino acid

SEQ ID NO: 2253 - protein, 306 aa, Homo sapiens; identical to SEQ ID NO: 2250
  misc_feature (1)..(1): Xaa can be any naturally occurring amino acid

SEQ ID NO: 2254 - protein, 2089 aa, Homo sapiens; identical to SEQ ID NO: 2244

SEQ ID NO: 2255 - protein, 2089 aa, Homo sapiens; identical to SEQ ID NO: 2244

SEQ ID NO: 2256 - protein, 1654 aa, Homo sapiens
YHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2257 - protein, 162 aa, Homo sapiens; identical to SEQ ID NO: 2246

SEQ ID NO: 2258 - protein, 113 aa, Homo sapiens; identical to SEQ ID NO: 2247

SEQ ID NO: 2259 - protein, 113 aa, Homo sapiens; identical to SEQ ID NO: 2247

SEQ ID NO: 2260 - protein, 127 aa, Homo sapiens; identical to SEQ ID NO: 2248

SEQ ID NO: 2261 - protein, 162 aa, Homo sapiens; identical to SEQ ID NO: 2246

SEQ ID NO: 2262 - protein, 113 aa, Homo sapiens; identical to SEQ ID NO: 2247

SEQ ID NO: 2263 - protein, 162 aa, Homo sapiens; identical to SEQ ID NO: 2246

SEQ ID NO: 2264 - protein, 127 aa, Homo sapiens; identical to SEQ ID NO: 2248

SEQ ID NO: 2265 - protein, 306 aa, Homo sapiens; identical to SEQ ID NO: 2250
  misc_feature (1)..(1): Xaa can be any naturally occurring amino acid

SEQ ID NO: 2266 - protein, 2089 aa, Homo sapiens; identical to SEQ ID NO: 2244

SEQ ID NO: 2267 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2268 - protein, 113 aa, Homo sapiens; identical to SEQ ID NO: 2247

SEQ ID NO: 2269 - protein, 162 aa, Homo sapiens; identical to SEQ ID NO: 2246

SEQ ID NO: 2270 - protein, 127 aa, Homo sapiens; identical to SEQ ID NO: 2248

SEQ ID NO: 2271 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2272 - protein, 245 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEA

SEQ ID NO: 2273 - protein, 113 aa, Homo sapiens; identical to SEQ ID NO: 2247

SEQ ID NO: 2274 - protein, 127 aa, Homo sapiens; identical to SEQ ID NO: 2248

SEQ ID NO: 2275 - protein, 2089 aa, Homo sapiens; identical to SEQ ID NO: 2244

SEQ ID NO: 2276 - protein, 162 aa, Homo sapiens; identical to SEQ ID NO: 2246

SEQ ID NO: 2277 - protein, 306 aa, Homo sapiens; identical to SEQ ID NO: 2250
  misc_feature (1)..(1): Xaa can be any naturally occurring amino acid

SEQ ID NO: 2278 - protein, 306 aa, Homo sapiens; identical to SEQ ID NO: 2250
  misc_feature (1)..(1): Xaa can be any naturally occurring amino acid

SEQ ID NO: 2279 - protein, 127 aa, Homo sapiens; identical to SEQ ID NO: 2248

SEQ ID NO: 2280 - protein, 306 aa, Homo sapiens; identical to SEQ ID NO: 2250
  misc_feature (1)..(1): Xaa can be any naturally occurring amino acid

SEQ ID NO: 2281 - protein, 162 aa, Homo sapiens; identical to SEQ ID NO: 2246

SEQ ID NO: 2282 - protein, 306 aa, Homo sapiens; identical to SEQ ID NO: 2250
  misc_feature (1)..(1): Xaa can be any naturally occurring amino acid

SEQ ID NO: 2283 - protein, 2089 aa, Homo sapiens; identical to SEQ ID NO: 2244

SEQ ID NO: 2284 - protein, 113 aa, Homo sapiens; identical to SEQ ID NO: 2247

SEQ ID NO: 2285 - protein, 244 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPHRGGLLSCQKRCHCRG

SEQ ID NO: 2286 - protein, 127 aa, Homo sapiens; identical to SEQ ID NO: 2248

SEQ ID NO: 2287 - protein, 113 aa, Homo sapiens; identical to SEQ ID NO: 2247

SEQ ID NO: 2288 - protein, 1802 aa, Homo sapiens; identical to SEQ ID NO: 2267

SEQ ID NO: 2289 - protein, 244 aa, Homo sapiens; identical to SEQ ID NO: 2285

SEQ ID NO: 2290 - protein, 1802 aa, Homo sapiens; identical to SEQ ID NO: 2267

SEQ ID NO: 2291 - protein, 244 aa, Homo sapiens; identical to SEQ ID NO: 2285

SEQ ID NO: 2292 - protein, 244 aa, Homo sapiens; identical to SEQ ID NO: 2285

SEQ ID NO: 2293 - protein, 245 aa, Homo sapiens; identical to SEQ ID NO: 2272

SEQ ID NO: 2294 - protein, 1825 aa, Homo sapiens; identical to SEQ ID NO: 2243

SEQ ID NO: 2295 - protein, 245 aa, Homo sapiens; identical to SEQ ID NO: 2272

SEQ ID NO: 2296 - protein, 1802 aa, Homo sapiens; identical to SEQ ID NO: 2267

SEQ ID NO: 2297 - protein, 245 aa, Homo sapiens; identical to SEQ ID NO: 2272

SEQ ID NO: 2298 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2299 - protein, 1825 aa, Homo sapiens; identical to SEQ ID NO: 2243

SEQ ID NO: 2300 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2301 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2302 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2303 - protein, 221 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILSSSLPPPQTSLLPLSLRLRLLGEEQIDPLSRLLKQLSPQPLSYRLPPPQTSLSPLSPHLGPLGEEKIGPLSRPLKQLCPQPLSSSLPPPQTNLSPLSPHLGPLGAGQIGPLSRPLNQLSL

SEQ ID NO: 2304 - protein, 221 aa, Homo sapiens; identical to SEQ ID NO: 2303

SEQ ID NO: 2305 - protein, 221 aa, Homo sapiens; identical to SEQ ID NO: 2303

SEQ ID NO: 2306 - protein, 245 aa, Homo sapiens; identical to SEQ ID NO: 2272

SEQ ID NO: 2307 - protein, 1655 aa, Homo sapiens; identical to SEQ ID NO: 2300

SEQ ID NO: 2308 - protein, 1825 aa, Homo sapiens; identical to SEQ ID NO: 2243

SEQ ID NO: 2309 - protein, 1655 aa, Homo sapiens; identical to SEQ ID NO: 2300

SEQ ID NO: 2310 - protein, 1655 aa, Homo sapiens; identical to SEQ ID NO: 2300

SEQ ID NO: 2311 - protein, 245 aa, Homo sapiens; identical to SEQ ID NO: 2272

SEQ ID NO: 2312 - protein, 244 aa, Homo sapiens; identical to SEQ ID NO: 2285

SEQ ID NO: 2313 - protein, 244 aa, Homo sapiens; identical to SEQ ID NO: 2285

SEQ ID NO: 2314 - protein, 1802 aa, Homo sapiens; identical to SEQ ID NO: 2267

SEQ ID NO: 2315 - protein, 1655 aa, Homo sapiens; identical to SEQ ID NO: 2300

SEQ ID NO: 2316 - protein, 1802 aa, Homo sapiens; identical to SEQ ID NO: 2267

SEQ ID NO: 2317 - protein, 221 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILSSSLPPPQTSLLPLSLRLRLLGEEQIDPLSRLLKQLSPQPLSYRLPPPQTSLSPLSPHLGPLGEEKIGPLSRPLKQLCPQPLRSSLPPPQTNLSPLSPHLGPLGAGQIGPLSRPLNQLSL

SEQ ID NO: 2318 - protein, 221 aa, Homo sapiens; identical to SEQ ID NO: 2303

SEQ ID NO: 2319 - protein, 245 aa, Homo sapiens; identical to SEQ ID NO: 2272

SEQ ID NO: 2320 - protein, 1825 aa, Homo sapiens; identical to SEQ ID NO: 2243

SEQ ID NO: 2321 - protein, 1825 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2322 - protein, 244 aa, Homo sapiens; identical to SEQ ID NO: 2285

SEQ ID NO: 2323 - protein, 244 aa, Homo sapiens; identical to SEQ ID NO: 2285

SEQ ID NO: 2324 - protein, 221 aa, Homo sapiens; identical to SEQ ID NO: 2303

SEQ ID NO: 2325 - protein, 221 aa, Homo sapiens; identical to SEQ ID NO: 2303

SEQ ID NO: 2326 - protein, 1825 aa, Homo sapiens; identical to SEQ ID NO: 2243

SEQ ID NO: 2327 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 2328 - protein, 245 aa, Homo sapiens; identical to SEQ ID NO: 2272

SEQ ID NO: 2329 - protein, 754 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 2330 - protein, 478 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERLHLKKKKKKK

SEQ ID NO: 2331 - protein, 1014 aa, Homo sapiens
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKVR

SEQ ID NO: 2332 - protein, 1068 aa, Homo sapiens
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKSLKDINNMIRQGEQRTKKRVIAIDSDAESPAKRVCQENDDVLLKRLQDVVSERANH

SEQ ID NO: 2333 - protein, 1139 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 2334 - protein, 849 aa, Homo sapiens
MESRCVAQAGMQWHDLGSLQPLPPRFKRFFCLSLLSSCEYSKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 2335 - protein, 555 aa, Homo sapiens
MQSLTKGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLE

SEQ ID NO: 2336 - protein, 518 aa, Homo sapiens
MISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 2337 - protein, 164 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 2338 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 2339 - protein, 261 aa, Homo sapiens; identical to SEQ ID NO: 2338

SEQ ID NO: 2340 - protein, 391 aa, Homo sapiens
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 2341 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 2342 - protein, 53 aa, Homo sapiens
MPPKTPRKTAATAAAAAAEPPAPPPPPPPEEDPEQDSGPEDLPLVRGSITNGR

SEQ ID NO: 2343 - protein, 907 aa, Homo sapiens
MPPKTPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 2344 - protein, 1233 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 2345 - protein, 203 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGCCGIYCHETPKRGQLYLKISRSGELAQEYDKRKKEMVKAEEDTQFNYHRKKNIAAERKEAKQEKE

SEQ ID NO: 2346 - protein, 516 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQVGPGLQPCSPKAIHTFLA

SEQ ID NO: 2347 - protein, 289 aa, Homo sapiens
  misc_feature (1)..(1): Xaa can be any naturally occurring amino acid
XWYTPTPFYSSLEAALLNFRPSAPVFRMLEVSIPTPHRYVRGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEI

SEQ ID NO: 2348 - protein, 785 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLRELNPMYEGYLQHDAQEVLQCILGNIQETCQLLKKEEVKNVAELPTKVEEIPHPKEEMNGINSIEMDSMRHSEDFKEKLPKGNGKRKSDTEFGNMKKKVKLSKEHQSLEENQRQTRSKRKATSDTLESPPKIIPKYISENESPRPSQKKSRVKINWLKSATKQPSILSKFCSLGKITTNQGVKGQSKENECDPEEDLGKCESDNTTNGCGLESPGNTVTPVNVNEVKPINKGEEQIGFELVEKLFQGQLVLRTRCLECESLTERREDFQDISVPVQEDELSKVEESSEISPEPKTEMKTLRWAISQFASVERIVGEDKYFCENCHHYTEAERSLLFDKMPEVITIHLKCFAASGLEFDCYGGGLSKINTPLLTPLKLSLEEWSTKPTNDSYGLFAVVMHSGITISSGHYTASVKVTDLNSLELDKGNFVVDQMCEIGKPEPLNEEEARGVVENYNDEEVSIRVGGNTQPSKVLNKKNVEAIGLLGGQKSKADYELYNKASNPDKVASTAFAENRNSETSDTTGTHESDRNKESSDQTGINISGFENKISYVVQSLKEYEGKWLLFDDSEVKVTEEKDFLNSLSPSTSPTSTPYLLFYKKL

SEQ ID NO: 2349 - protein, 785 aa, Homo sapiens; identical to SEQ ID NO: 2348

SEQ ID NO: 2350 - protein, 186 aa, Homo sapiens
MPGVIPSESNGLSRGSPSKKNRLSLKFFQKKETKRALDFTDSQENEEKASEYRASEIDQVVPAAQSSPINCEKRENLLPFVGLNNLGNTCYLNSILQVLYFCPGFKSGVKHLFNIISRKKEALKDEANQKDKGNCKEDSLASYELICSLQSLIISVEQLQASFLLNPEKYTDELATQPRRLLNTLR

SEQ ID NO: 2351 - protein, 118 aa, Homo sapiens
MSGGSSCSQTPSRAIPATRRVVLGDGVQLPPGDYSTTPGGTLFSTTPGGTRIIYDRKFLMECRNSPVTKTPPRDLPTIPGVTSPSSDEPPMEASQSHLRNSPEDKRAGGEESQFEMDI

SEQ ID NO: 2352 - protein, 787 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 2353 - protein, 789 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 2354 - protein, 416 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQEL

SEQ ID NO: 2355 - protein, 740 aa, Homo sapiens
MYHHWVQPLPLETLDLEFKVEEPLSRGLLSGDQAGLKYLLLAFLRLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKPLTYRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 2356 - protein, 416 aa, Homo sapiens; identical to SEQ ID NO: 2354

SEQ ID NO: 2357 - protein, 774 aa, Homo sapiens
MAATTANPEMTSDVPSLGPAIASGNSGPGIQGGGAIVQRAIKRRPGLDFDDDGEGNSKFLRCDDDQMSNDKERFARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 2358 - protein, 775 aa, Homo sapiens
MTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPADDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 2359 - protein, 459 aa, Homo sapiens
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 2360 - protein, 356 aa, Homo sapiens [sequence omitted]

SEQ ID NO: 2361 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 2362 - protein, 977 aa, Homo sapiens
MHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 2363 - protein, 2404 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 2364 - protein, 2472 aa, Homo sapiens
LRGAVAVAEIWPPPPPPGLRPPSPSAPARPLAARARSSPSQPAGPPTPVRALAGPAARARGCFREQVKMAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQAILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 2365 - protein, 193 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 2366 - protein, 193 aa, Homo sapiens; identical to SEQ ID NO: 2365

SEQ ID NO: 2367 - protein, 141 aa, Homo sapiens
MPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAG

SEQ ID NO: 2368 - protein, 138 aa, Homo sapiens
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATP

SEQ ID NO: 2369 - protein, 106 aa, Homo sapiens
  misc_feature (1)..(1): Xaa can be any naturally occurring amino acid
XPTTSRPALDVKGGTSPAKEDANQEMSSVAYSNLAVKDRKAVAILHYPGVASNGTKSPAIIDSDPVDEEVLMSLVVELGLDRANELPELWLGQNEFDFTADFPSSC

SEQ ID NO: 2370 - protein, 219 aa, Homo sapiens
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSFNLHPAPHLLASMHLQKLNSQYQGMAAATPGQPGEAGPLQNWDFGAQAGGAESLSPSAGAQSPAIIDSDPVDEEVLMSLVVELGLDRANELPELWLGQNEFDFTADFPSSC

SEQ ID NO: 2371 - protein, 193 aa, Homo sapiens; identical to SEQ ID NO: 2365

SEQ ID NO: 2372 - protein, 109 aa, Homo sapiens
MEPSAQQLQLAASLPANLSNFCQGSEMPTTSRPALDVKGGTSPAKEDANQEMSSVAYSNLAVKDRKAVAILHYPGVASNGTKASGAPTSSSGSPIGSPTTTPPTKPPSF

SEQ ID NO: 2373 - protein, 219 aa, Homo sapiens; identical to SEQ ID NO: 2370

SEQ ID NO: 2374 - protein, 270 aa, Homo sapiens
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 2375 - protein, 214 aa, Homo sapiens
MADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPPNVIDTDFIDEEVLMSLVIEMGLDRIKELPELWLGQNEFDFMTDFVCKQQPSRVSC

SEQ ID NO: 2376 - protein, 270 aa, Homo sapiens; identical to SEQ ID NO: 2374

SEQ ID NO: 2377 - protein, 270 aa, Homo sapiens; identical to SEQ ID NO: 2374

SEQ ID NO: 2378 - protein, 184 aa, Homo sapiens
MADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 2379 - protein, 184 aa, Homo sapiens; identical to SEQ ID NO: 2378

SEQ ID NO: 2380 - protein, 190 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 2381 - protein, 38 aa, Homo sapiens
  misc_feature (1)..(1): Xaa can be any naturally occurring amino acid
XQESEFLCLEFDEVKVNQILKTLSEVEESISTLISQPN

SEQ ID NO: 2382 - protein, 32 aa, Homo sapiens
  misc_feature (1)..(1): Xaa can be any naturally occurring amino acid
XCLEFDEVKVNQILKTLSEVEESISTLISQPN

SEQ ID NO: 2383 - protein, 38 aa, Homo sapiens; identical to SEQ ID NO: 2381
  misc_feature (1)..(1): Xaa can be any naturally occurring amino acid

SEQ ID NO: 2384 - protein, 159 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQVHCNQ

SEQ ID NO: 2385 - protein, 51 aa, Homo sapiens
MKNREAARECRRKKKEYVKCLENRVAVLENQNKTLIEELKALKDLYCHKSD

SEQ ID NO: 2386 - protein, 327 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 2387 - protein, 371 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 2388 - protein, 230 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSALPTQPAEEAARKREVRLMKNREAARECRRKKKEYVKCLENRVAVLENQNKTLIEELKALKDLYCHKSD

SEQ ID NO: 2389 - protein, 327 aa, Homo sapiens; identical to SEQ ID NO: 2386

SEQ ID NO: 2390 - protein, 341 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQAASGDVQTYQIRTAPTSTIAPGVVMASSPALPTQPAEEAARKREVRLMKNREAARECRRKKKEYVKCLENRVAVLENQNKTLIEELKALKDLYCHKSD

SEQ ID NO: 2391 - protein, 182 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQY

SEQ ID NO: 2392 - protein, 132 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQSSCKDLKRLFSGTQISTIAESEDSQESVDSVTDSQKRREILSRRP

SEQ ID NO: 2393 - protein, 234 aa, Homo sapiens
MTMESGAENQQSGDAAVTEAENQQMTVQAQPQIATLAQVSMPAAHATSSAPTVTLVQLPNGQTVQVHGVIQAAQPSVIQSPQVQTVQISTIAESEDSQESVDSVTDSQKRREILSRRPSYRKILNDLSSDAPGVPRIEEEKSEEETSAPAITTVTVPTPIYQTSSGQYIAITQGGAIQLANNGTDGVQGLQTLTMTNAAATQPGTTILQYAQTTDGQQILVPSNQVVVQGTQKL

SEQ ID NO: 2394 - protein, 153 aa, Homo sapiens
MPAAHATSSAPTVTLVQLPNGQTVQVHGVIQAAQPSVIQSPQVQTVQSSCKDLKRLFSGTQISTIAESEDSQESVDSVTDSQKRREILSRRPSYRKILNDLSSDAPGVPRIEEEKSEEETSAPAITTVTVPTPIYQTSSGQYTYLRDTTYSCQ

SEQ ID NO: 2395 - protein, 237 aa, Homo sapiens
MLDLTSRGQVGTSRRMAEAACSAHFLETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 2396 - protein, 217 aa, Homo sapiens [sequence omitted]

SEQ ID NO: 2397 - protein, 632 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 2398 - protein, 576 aa, Homo sapiens
MRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLVCWGINGILWPSLPSWLKPTVL

SEQ ID NO: 2399 - protein, 349 aa, Homo sapiens
MAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 2400 - protein, 667 aa, Homo sapiens
MDWQDHRSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 2401 - protein, 613 aa, Homo sapiens
MRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 2402 - protein, 669 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGLGPSLLSPYSDEDTTQPGGPFQPRAGSAQAD

SEQ ID NO: 2403 - protein, 363 aa, Homo sapiens
MALGLQRARSTTELRKEKSRDAARSRRSQETEVLYQLAHTLPFARGVSAHLDKASIMRLTISYLRMHRLCAAGEWNQVGAGGEPLDACYLKALEGFVMVLTAEGDMAYLSENVSKHLGLSQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTCMYPISPGAKPAATWPPADTRTPQLPIPQDALPPHLNTSSLLPKPQGTVSFLAPSYPVPRYFSPHLPPWWP

SEQ ID NO: 2404 - protein, 612 aa, Homo sapiens
MLPMPSGRPRSCARKSPGMRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPDDLIGCSAYEYIHALDSDAVSKSIHTLLSKGQAVTGQYRFLARSGGYLWTQTQATVVSGGRGPQSESIVCVHFLISQVEETGVVLSLEQTEQHSRRPIQRGAPSQKDTPNPGDSLDTPGPRILAFLHPPSLSEAALAADPRRFCSPDLRRLLGPILDGASVAATPSTPLATRHPQSPLSADLPDELPVGTENVHRLFTSGKDTEAVETDLDIAQDADALDLEMLAPYISMDDDFQLNASEQLPRAYHRPLGAVPRPRARSFHGLSPPALEPSLLPRWGSDPRLSCSSPSRGDPSASSPMAGARKRTLAQSSEDEDEGVELLGVRPPKRSPSPEHENFLLFPLSLSFLLTGGPAPGSLQDPSTPLLNLNEPLGFHFVTQSGVQWHKHSSPQPRPPGLK

SEQ ID NO: 2405 - protein, 382 aa, Homo sapiens
MVSVGCVVFLFFFFGVRNRRSFRFRWGPSLAAEMAATAAEAVASGSGEPREEAGALGPAWDESQLRSYSFPTRPIPRLSQSDPRAEELIENEEPVVLTDTNLVYPALKWDLEYLQENIGNGDFSVYSASTHKFLYYDEKKMANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKGAPTPKRIEYPLKAHQKVAIMRNIEKMLGEALGNPQEVGPLLNTMIKGRYN

SEQ ID NO: 2406 - protein, 199 aa, Homo sapiens
MRPAAGAARRPRCCTSWLTRCPSPAASAPTWTRPLSCASPSATCACTASAPQLELIGHSIFDFIHPCDQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEPPLGRGAFLSRHSLDMKFTYCDDRIAEVAGYSPMT

SEQ ID NO: 2407 - protein, 237 aa, Homo sapiens
MRPAAGAARRPRCCTSWLTRCPSPAASAPTWTRPLSCASPSATCACTASAPQEELQDALTPQQTLSRRKVEAPTERCFSLRMKSTLTSRGRTLNLKAATWKVLNCSGHMRAYKPPAQTSPAGSPDSEPPLQCLVLICEAIPHPGSLERFVPVSSAATSLCLPSLSPSKVAGYSPDDLIGCSAYEYIHALDSDAPQDALPPHLNTSSLLPKPQGTVSFLAPSYPVPRYFSPHLPPWWP

SEQ ID NO: 2408 - protein, 363 aa, Homo sapiens; identical to SEQ ID NO: 2403

SEQ ID NO: 2409 - protein, 192 aa, Homo sapiens
MANFQNFKPRSNREEMKFHEFVEKLQDIQQRGGEERLYLQQTLNDTVGRKIVMDFLGFNWNWINKQQGKRGWGQLTSNLLLIGMEGNVTPAHYDEQQNFFAQIKGYKRCILFPPDQFECLYPYPVHHPCDRQSQVDFDNPDYERFPNFQNVVGYETVVGPGDVLYIPMYWWHHIESLLNGGITITVNFWYKG

SEQ ID NO: 2410 - protein, 176 aa, Homo sapiens; identical to SEQ ID NO: 1691

SEQ ID NO: 2411 - protein, 217 aa, Homo sapiens [sequence omitted]

SEQ ID NO: 2412 - protein, 217 aa, Homo sapiens [sequence omitted]

SEQ ID NO: 2413 - protein, 217 aa, Homo sapiens [sequence omitted]

SEQ ID NO: 2414 - protein, 474 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 2415 - protein, 452 aa, Homo sapiens
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 2416 - protein, 504 aa, Homo sapiens
MRLSKTLVDMDMADYSAALDPAYTTLEFENVQVLTMGNVLLPLRLARLRHPLRHHWSISGGVDSSPQGDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 2417 - protein, 464 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 2418 - protein, 417 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGPCQAQEGRGWSGDSPGDRPHTVSSPLSSLASPLCRFGQVA

SEQ ID NO: 2419 - protein, 442 aa, Homo sapiens
MVSVNAPLGAPVESSYDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 2420 - protein, 474 aa, Homo sapiens; identical to SEQ ID NO: 2414

SEQ ID NO: 2421 - protein, 291 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2422 - protein, 297 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2423 - protein, 194 aa, Homo sapiens
MQRARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2424 - protein, 153 aa, Homo sapiens
  misc_feature (1)..(1): Xaa can be any naturally occurring amino acid
XSEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2425 - protein, 143 aa, Homo sapiens
  misc_feature (1)..(1): Xaa can be any naturally occurring amino acid
XESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2426 - protein, 263 aa, Homo sapiens
MQRARPTLWAACEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2427 - protein, 277 aa, Homo sapiens [sequence omitted]

SEQ ID NO: 2428 - protein, 189 aa, Homo sapiens [sequence omitted]

SEQ ID NO: 2429 - protein, 268 aa, Homo sapiens
MQRARPTLWAAALTLLVLLRGPPVARAGASSAGLGPVVRREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2430 - protein, 334 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 2431 - protein, 347 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 2432 - protein, 329 aa, Homo sapiens
MAKSMPSKSSRNKQGTVGVGCFERWRRCISVRETSSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 2433 - protein, 424 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 2434 - protein, 465 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 2435 - protein, 347 aa, Homo sapiens; identical to SEQ ID NO: 2431

SEQ ID NO: 2436 - protein, 178 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILC

SEQ ID NO: 2437 - protein, 133 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGTYR

SEQ ID NO: 2438 - protein, 465 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 2439 - protein, 414 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 2440 - protein, 334 aa, Homo sapiens
MLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 2441 - protein, 405 aa, Homo sapiens
MPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 2442 - protein, 138 aa, Homo sapiens
MREENKGMPSGGGSDEGLASAAARGLVEKVRQLLEAGADPNGVNRFGRRAIQVMMMGSARVAELLLLHGAEPNCADPATLTRPVHDAAREGFLDTLVVLHRAGARLDVRDAWGRLPVDLAEERGHRDVAGYLRTATGD

SEQ ID NO: 2443 - protein, 78 aa, Homo sapiens
MREENKGMPSGGGSDEGLASAAARGLVEKVRQLLEAGADPNGVNRFGRRAIQVAGAPGPRRQGARERGARPRRIGAGT

SEQ ID NO: 2444 - protein, 2414 aa, Homo sapiens
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGMNAGMNPGMLAAGNGQGIMPNQVMNGSIGAGRGRQNMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPTAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPAAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQQQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 2445 - protein, 1290 aa, Homo sapiens
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 2446 - protein, 859 aa, Homo sapiens
MLEVLEEIWSVRARRAHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGSHLGPPGACPLPSLGLDCWGVGLKGGVSAPGTQAGVASTTRPCLGTGPSLASPH

SEQ ID NO: 2447 - protein, 218 aa, Homo sapiens
MATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 2448 - protein, 91 aa, Homo sapiens
MKLNISFPATGCQKLIEVDDERKLRTFYEKRMATEVAADALGEEWKVKVDKLLQVFKSETVNAIGNWYLEWGSDSGFWLLTFGKLLPNATL

SEQ ID NO: 2449 - protein, 218 aa, Homo sapiens; identical to SEQ ID NO: 2447

SEQ ID NO: 2450 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 2451 - protein, 482 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 2452 - protein, 482 aa, Homo sapiens; identical to SEQ ID NO: 2451

SEQ ID NO: 2453 - protein, 370 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPPPPPRSPACPRCCRPLPRRRAPPPRPSCRTRWRPLGRRTPSTRTAAPTCPSPGPASRGTRRALLRKIPRSQERKLPESLRPEGRRFKQSEKLKYP

SEQ ID NO: 2454 - protein, 1399 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 2455 - protein, 1441 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 2456 - protein, 1440 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQVQQVQVFADVQCTVNLVGGDPYLNQPGPLGTQKPTSGPQTPQAQQKSLLQQLLTE

SEQ ID NO: 2457 - protein, 1399 aa, Homo sapiens; identical to SEQ ID NO: 2454

SEQ ID NO: 2458 - protein, 1441 aa, Homo sapiens; identical to SEQ ID NO: 2455

SEQ ID NO: 2459 - protein, 1399 aa, Homo sapiens; identical to SEQ ID NO: 2454

SEQ ID NO: 2460 - protein, 1807 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2461 - protein, 1784 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2462 - protein, 1764 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2463 - protein, 1692 aa, Homo sapiens
MECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2464 - protein, 1741 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2465 - protein, 1704 aa, Homo sapiens
MAKPTSKDSGLKEKFKILLGLGTPRPNPRSAEGKQTEFIITAEILRELSMECGLNNRIRMIGQICEVAKTKKFEEGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 2466 - protein, 261 aa, Homo sapiens; identical to SEQ ID NO: 1367

SEQ ID NO: 2467 - protein, 498 aa, Homo sapiens
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 2468 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 2469 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 2470 - protein, 190 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPAAIAEAEAGKYGQESEFLCLEFDEVKANQIAKTASEAEESISTLISQPN

SEQ ID NO: 2471 - protein, 211 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPAAIAEAEAGKYGQESEFLCLEFDEVKANQIAKTASEAEESISTLISQPNPKKKRKVPKKKRKVPKKKRKV

SEQ ID NO: 2472 - protein, 211 aa, Homo sapiens
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPNPKKKRKVPKKKRKVPKKKRKV

SEQ ID NO: 2473 - protein, 190 aa, Homo sapiens; identical to SEQ ID NO: 2380

SEQ ID NO: 2474 - protein, 492 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 2475 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 2476 - protein, 75 aa, Homo sapiens
MGRDYRTCLTIVQKLKKMVDKPTQRSVSNAATRVCRTGRSRWRDVCRNFMRRYQSRVTQGLVAGETAQQICEDLR

SEQ ID NO: 2477 - protein, 96 aa, Homo sapiens
MATWALLLLAAMLLGNPGLVFSGRDYRTCLTIVQKLKKMVDKPTQRSVSNAATRVCRTGRSRWRDVCRNFMRRYQSRVTQGLVAGETAQQICEDLR

SEQ ID NO: 2478 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 2479 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2480 - protein, 194 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 2481 - protein, 465 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 2482 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAETQKLISEIDLLRKQNEQLKHKLEQLRNSCA

SEQ ID NO: 2483 - protein, 90 aa, Homo sapiens
MTEENVKRRTHNVLERQRRNELKRSFFALRDQIPELENNEKAPKVVILKKATAYILSVQAETQKLISEIDLLRKQNEQLKHKLEQLRNSC

SEQ ID NO: 2484 - protein, 290 aa, Homo sapiens
MIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYHDEVDGGSPMENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETD

SEQ ID NO: 2485 - protein, 285 aa, Homo sapiens
MIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYHGSPMENTENSVASKSIKNLEPKIIHGSESMASGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETD

SEQ ID NO: 2486 - protein, 300 aa, Homo sapiens
MVEIDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSNLEHHHHHHVEIDGGSPMSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVD

SEQ ID NO: 2487 - protein, 282 aa, Homo sapiens; identical to SEQ ID NO: 1985

SEQ ID NO: 2488 - DNA, 2043 bp, Homo sapiens
taatacgactcactatagggaaataagagagaaaagaagagtaagaagaaatataagagccaccatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattcaagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctttagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttgataataggctggagcctcggtggccatgcttcttgccccttgggcctccccccagcccctcctccccttcctgcacccgtacccccgtggtctttgaataaagtctgagtgggcggctctaga

SEQ ID NO: 2489 - RNA, 1325 nt, Homo sapiens
gggaaauaagagagaaaagaagaguaagaagaaauauaagagccaccauggaagagccacagucagacccgagcguggagccgccauugagccaggagacuuucagcgacuuguggaaacuucucccggaaaacaaugugcugucaccguugccgagccaggcgauggaugaccugaugcuuucgccggacgacaucgagcagugguucacugaagaucccggaccggacgaggcaccgagaaugcccgaagcggcuccgccuguggcgccugccccagcagcgcccacgcccgcagcgcccgccccggcaccaagcuggccgcugucgucaucagugcccucgcaaaagaccuaucagggaucguacggguuccgccugggcuuucuucacucgggaacggccaagucggucacaugcacguacuccccagcgcucaacaaaauguucugccaguuggcaaaaacgugucccguccaacucuggguggauuccacacccccacccgguacaaggguacgagccauggcaaucuacaagcagucccaacacaugacggaagucgugcggcggugcccccaccaugagcggugcucagauucagauggucuugcuccgccccagcacuugauuaggguggaagguaaccucagagucgaguaucuugaugacagaaauaccuuucggcacuccgugguaguccccuaugaacccccggaaguggggucggacuguacuaccauccauuacaacuauaugugcaauucgagcuguaugggcgggaugaaucgacggccuauccucaccaucauuacguuggaagauagcucgggaaaccugcucggucgcaacagcuuugagguccgaguaugugccugcccgggacgcgaccgacgcacagaggaagagaacuugaggaaaaagggagagccccaucacgaguugcccccuggaucgacgaaacgcgcgcucccuaacaauacaucaucaucaccucagccgaagaagaaaccgcuugauggggaauacuuuacgcuucagauuagggguagagagagauucgaaauguuuagagaguugaaugaggcccucgagcuuaaagacgcgcaagcgggaaaggagcccgguggcuccagggcucauuccucgcaccuuaagagcaagaaagggcagucgacgucgcggcauaagaaacucauguucaagacagaagggcccgacagcgauugauaagcugccuucugcggggcuugccuucuggccaugcccuucuucucucccuugcaccuguaccucuuggucuuugaauaaagccugaguaggaag

SEQ ID NO: 2490 - RNA, 1325 nt, Homo sapiens; identical to SEQ ID NO: 2489

SEQ ID NO: 2491 - RNA, 1613 nt, Homo sapiens
gggaaauaagagagaaaagaagaguaagaagaaauauaagagccaccauggccccugucgcggugugggcggcucuugcgguaggccucgaacucugggcggcagcucacgcccugccagcccaagucgccuucacgccuuacgcgccagaacccgggucaacuugucgccuuagggaguauuaugaccaaacggcucagauguguugcagcaaaugcucgccagggcagcacgcaaaaguguuuuguacuaagacguccgauacgguaugugauucaugugaggacuccaccuacacucagcuuuggaauugggugcccgagugccugucaugcgggucgcgcugcucgucggaucagguagaaacucaagcgugcacucgagaacagaacagaauuuguacgugcaggcccgguugguacugcgccuugucgaagcaggaaggcugcaggcuuugugcgccgcuucgcaaguguaggccuggauuuggagucgcgaggccgggaaccgagacauccgacguagucuguaagcccugugcuccgggaacguucuccaacacaacuucgagcacggacaucugucggccccaccagauuugcaauguaguggcaauccccgggaacgcgucaauggacgccgucuguacguccaccucgcccacuagauccauggcaccgggagcagugcauuugccgcagcccgugucgacgcgaucacagcacacacagcccacaccagagccuucgacagcgccgucgacaucauucuugcugccgauggggccgucgccgccugccgagggcucaacuggugaugagccgaaaagcugcgacaaaacgcauacauguccgcccugccccgcucccgaacuccucggugggccuagcguguuucuguucccaccaaaaccgaaagauaccuugaugaucucacggaccccugaagugacgugcguggucgucgaugucucgcaugaggaccccgaggugaaguuuaacugguacgucgacggaguggaagugcacaaugccaagaccaagcccagagaggaacaguacaacuccacuuacagagucgugucgguacucacugucuugcaucaggauuggcugaacggaaaggaguauaagugcaaaguaucgaacaaagcgcugccagcgccgaucgagaaaacaaucagcaaagcgaagggacagccucgcgaaccucaaguguauacguugccgcccucacgagaggaaaugacgaagaaucaggucagccucacgugcuuggugaaaggcuucuauccgagcgauauugccguggagugggaguccaauggucagccagagaacaauuacaagacgacaccgccugucuuggauucggacgggagcuuuuucuuguacucgaaacucacgguagacaagagcagauggcaacaggggaauguauucucguguucagugaugcacgaggcgcuccacaaccauuauacacaaaagucgcucucguugucaccgggaaagugauaagcugccuucugcggggcuugccuucuggccaugcccuucuucucucccuugcaccuguaccucuuggucuuugaauaaagccugaguaggaag

SEQ ID NO: 2492 - DNA, 1683 bp, Homo sapiens
taatacgactcactatagggaaataagagagaaaagaagagtaagaagaaatataagagccaccatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtttagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgataataggctggagcctcggtggccatgcttcttgccccttgggcctccccccagcccctcctccccttcctgcacccgtacccccgtggtctttgaataaagtctgagtgggcggctctaga

SEQ ID NO: 2493 - DNA, 1377 bp, Homo sapiens
taatacgactcactatagggaaataagagagaaaagaagagtaagaagaaatataagagccaccatggtggccggtacccgctgcctcctcgcgctgcttttgccccaagtgttgctgggtggcgcagccggactcgtcccagagcttggacgaaggaagtttgcagcagcctcgtcaggtagaccctcttcgcaaccttcggatgaggtgctgagcgaatttgaattgcggctgctctccatgtttggactgaagcagcgtccgactccatcgcgcgacgcggtggtgccaccttacatgcttgacctctaccgcagacacagcggacaacctggcagccctgcacccgatcaccggctggagagagcagcaagcagggcaaatactgtccggtcgtttcatcatgaagagagccttgaagaactgccagaaacctccggaaagaccacgagacggtttttcttcaatctttcttcgattccaaccgaagaattcataactagcgcagaacttcaagtttttcgcgagcagatgcaagatgcacttggaaacaactcctcattccatcatcgaatcaacatatacgaaatcatcaagccggcaaccgccaactcaaagttcccggtgactcgtctgcttgatacgcgcctggtcaaccaaaacgcttcccgctgggaatcattcgatgtcaccccagccgttatgagatggactgctcaaggacacgcaaaccatgggtttgtggtggaagtggcccatcttgaagaaaagcagggggtgagcaagcgtcacgtgagaatttcgagatccctgcatcaggatgaacattcatggtcgcaaattcggccactcctggtcacttttggccacgatggtaaaggacaccctctgcataagagggagaaaagacaggcgaagcataaacagaggaagagactgaagtccagctgcaagcgacatcccctttacgtggacttctcggacgtggggtggaatgactggattgtggcacctcctggctaccacgccttttactgtcatggagaatgtccctttccactggcggatcacctcaattccaccaatcatgcaattgtgcaaacccttgtgaactcagtcaattccaaaatccctaaggcttgttgtgtccctactgagctctccgcaatttcgatgctctaccttgatgagaacgagaaagtcgtgctgaaaaactatcaggacatggtcgtggagggttgtggttgccggtgataataggctggagcctcggtggccatgcttcttgccccttgggcctccccccagcccctcctccccttcctgcacccgtacccccgtggtctttgaataaagtctgagtgggcggctctaga

SEQ ID NO: 2494 - DNA, 414 bp, Homo sapiens
taatacgactcactatagggaaataagagagaaaagaagagtaagaagaaatataagagccaccatgggaagagattaccggacctgtctgactatcgtgcaaaaactgaagaagatggtggacaagccgacccagcggtccgtgagcaacgctgccacgagggtctgccgcactgggcggtcgcgctggagggacgtgtgcagaaatttcatgcgccgctaccagtcaagagtgactcagggactcgtcgcaggcgaaaccgcgcagcaaatctgcgaggatttgcggtgataataggctggagcctcggtggccatgcttcttgccccttgggcctccccccagcccctcctccccttcctgcacccgtacccccgtggtctttgaataaagtctgagtgggcggctctaga

SEQ ID NO: 2495 - DNA, 477 bp, Homo sapiens
taatacgactcactatagggaaataagagagaaaagaagagtaagaagaaatataagagccaccatggccacttgggctctccttctcctggcggcgatgctgctgggtaacccagggctggtgtttagcggacgcgactaccggacgtgcctcactatcgtccagaaactgaagaagatggtcgataagccgactcagaggtcggtgtccaacgccgccaccagagtgtgccgcaccggcagatcgaggtggcgggacgtctgtcgcaatttcatgcgcagataccagtcacgggtgacccaaggattggtggcaggagaaaccgcacaacagatttgcgaggatctgcggtgataataggctggagcctcggtggccatgcttcttgccccttgggcctccccccagcccctcctccccttcctgcacccgtacccccgtggtctttgaataaagtctgagtgggcggctctaga

SEQ ID NO: 2496 - DNA, 1584 bp, Homo sapiens
taatacgactcactatagggaaataagagagaaaagaagagtaagaagaaatataagagccaccatgggcggagctgtggtggacgaggggcctaccggtgtgaaggcgcctgatggtggctggggctgggcagtcctgtttgggtgtttcgtgattaccggcttttcctacgccttccctaaagcagtgtcagtgttcttcaaggaactcattcaagaattcggcattggctactcggacactgcatggatctccagcattctgcttgcgatgctctacggaaccggaccactttgttccgtctgtgtgaaccgcttcggatgtcggcctgttatgcttgtcggtggtctttttgcctcacttggtatggtcgcagcatcgttttgtcgctccatcattcaagtgtatctgaccactggtgtcattaccggtctgggtcttgcacttaactttcagccgtctctgataatgcttaatcgatacttttcaaagagacggcctatggcgaacgggctggcagcagcgggatcgcctgtgtttctctgtgcactttcgccgctgggacagcttctccaagaccgatacgggtggagaggcggattccttattcttggtggattgttgctcaattgctgtgtgtgcgcagccctgatgcgtccgctggtcgtgactgcacagccagggtcgggaccaccaagaccttcgaggaggctgctggatctcagcgtgttccgtgatagaggatttgtgctgtacgccgtggcagcaagcgtgatggtgcttggactttttgtgccacccgtctttgtggtgtcgtacgccaaggatctgggtgtgcctgatactaaggccgcattcctcctgaccattctgggctttatcgacatcttcgccagaccagcagctggctttgtggccggacttggaaaggtccgcccatacagcgtgtacttgttttccttctcaatgtttttcaatgggctggctgatctggcaggtagcactgctggagattacggcggtctggtggtcttttgcatcttctttggcatctcgtacggaatggtgggtgccttgcaatttgaagttctgatggccatagtgggaacccacaagtttagctcggcaattggactggtcttgctgatggaagcagtcgctgtgcttgtcggacctccttccggtgggaaacttcttgatgcaacccatgtgtacatgtatgtgtttatcctggcgggagcggaagtgctcacttcctcactcattctcctccttgggaactttttctgcatacggaaaaagcccaaagaacctcagcccgaggtggcagcagccgaagaggaaaagctgcataagcccccagcagacagcggagttgatctcagggaggtcgaacactttctcaaagcggaacccgaaaagaacggagaggtggtccatacgccagagacgtccgtctgataataggctggagcctcggtggccatgcttcttgccccttgggcctccccccagcccctcctccccttcctgcacccgtacccccgtggtctttgaataaagtctgagtgggcggctctaga

SEQ ID NO: 2497 - protein, 4 aa, Homo sapiens
  MOD_RES (2)..(3): Xaa = Any amino acid
RXXR

SEQ ID NO: 2498 - protein, 4 aa, Homo sapiens
  MOD_RES (2)..(2): Xaa = any amino acid
  MOD_RES (3)..(3): Xaa = Lys or Arg
RXXR

SEQ ID NO: 2499 - protein, 6 aa, Homo sapiens
  MOD_RES (1)..(1): Xaa = Lys or Arg
  MOD_RES (2)..(5): Xaa = Any amino acid
  MOD_RES (6)..(6): Xaa = Lys or Arg
XXXXXX

SEQ ID NO: 2500 - protein, 8 aa, Homo sapiens
  MOD_RES (1)..(1): Xaa = Lys or Arg
  MOD_RES (2)..(7): Xaa = Any amino acid
  MOD_RES (8)..(8): Xaa = Lys or Arg
XXXXXXXX

SEQ ID NO: 2501 - protein, 6 aa, Homo sapiens
LVPRGS

SEQ ID NO: 2502 - protein, 4 aa, Homo sapiens
LVPR

SEQ ID NO: 2503 - protein, 4 aa, Homo sapiens
  MOD_RES (1)..(1): Xaa = Ala, Phe, Gly, Ile, Leu, Thr, Val or Met
  MOD_RES (2)..(2): Xaa = Ala, Phe, Gly, Ile, Leu, Thr, Val, or Trp
XXPR

SEQ ID NO: 2504 - protein, 4 aa, Homo sapiens
IEGR

SEQ ID NO: 2505 - protein, 4 aa, Homo sapiens
IDGR

SEQ ID NO: 2506 - protein, 4 aa, Homo sapiens
AEGR

SEQ ID NO: 2507 - protein, 4 aa, Homo sapiens
  MOD_RES (1)..(1): Xaa = Ala, Phe, Gly, Ile, Leu, Thr, Val or Met
  MOD_RES (2)..(2): Xaa = Asp or Glu
XXGR

SEQ ID NO: 2508 - RNA, 22 nt, Homo sapiens
cuguacagccuccuagcuuucc

SEQ ID NO: 2509 - RNA, 21 nt, Homo sapiens
cuauacaaucuacugucuuuc

SEQ ID NO: 2510 - RNA, 22 nt, Homo sapiens
ugagguaguagguuguauaguu

SEQ ID NO: 2511 - RNA, 22 nt, Homo sapiens
cuauacaaccuacugccuuccc

SEQ ID NO: 2512 - RNA, 22 nt, Homo sapiens
ugagguaguagguugugugguu

SEQ ID NO: 2513 - RNA, 22 nt, Homo sapiens
ugagguaguagguuguaugguu

SEQ ID NO: 2514 - RNA, 22 nt, Homo sapiens
cuauacgaccugcugccuuucu

SEQ ID NO: 2515 - RNA, 22 nt, Homo sapiens
agagguaguagguugcauaguu

SEQ ID NO: 2516 - RNA, 22 nt, Homo sapiens
cuauacggccuccuagcuuucc

SEQ ID NO: 2517 - RNA, 22 nt, Homo sapiens
ugagguaggagguuguauaguu

SEQ ID NO: 2518 - RNA, 22 nt, Homo sapiens
cuauacaaucuauugccuuccc

SEQ ID NO: 2519 - RNA, 22 nt, Homo sapiens
cuauacagucuacugucuuucc

SEQ ID NO: 2520 - RNA, 22 nt, Homo sapiens
ugagguaguagauuguauaguu

SEQ ID NO: 2521 - RNA, 21 nt, Homo sapiens
cuguacaggccacugccuugc

SEQ ID NO: 2522 - RNA, 22 nt, Homo sapiens
ugagguaguaguuuguacaguu

SEQ ID NO: 2523 - RNA, 22 nt, Homo sapiens
cugcgcaagcuacugccuugcu

SEQ ID NO: 2524 - RNA, 22 nt, Homo sapiens
ugagguaguaguuugugcuguu

SEQ ID NO: 2525 - RNA, 22 nt, Homo sapiens
uggaauguaaagaaguauguau

SEQ ID NO: 2526 - RNA, 22 nt, Homo sapiens
caagcuuguaucuauagguaug

SEQ ID NO: 2527 - RNA, 22 nt, Homo sapiens
aacccguagauccgaacuugug

SEQ ID NO: 2528 - RNA, 21 nt, Homo sapiens
uacaguacugugauaacugaa

SEQ ID NO: 2529 - RNA, 22 nt, Homo sapiens
caguuaucacagugcugaugcu

SEQ ID NO: 2530 - RNA, 23 nt, Homo sapiens
agcuucuuuacagugcugccuug

SEQ ID NO: 2531 - RNA, 23 nt, Homo sapiens
agcagcauuguacagggcuauga

SEQ ID NO: 2532 - RNA, 23 nt, Homo sapiens
ucauagcccuguacaaugcugcu

SEQ ID NO: 2533 - RNA, 22 nt, Homo sapiens
acggauguuugagcaugugcua

SEQ ID NO: 2534 - RNA, 23 nt, Homo sapiens
ucaaaugcucagacuccuguggu

SEQ ID NO: 2535 - RNA, 22 nt, Homo sapiens
cugcaauguaagcacuucuuac

SEQ ID NO: 2536 - RNA, 23 nt, Homo sapiens
aaaagugcuuacagugcagguag

SEQ ID NO: 2537 - RNA, 22 nt, Homo sapiens
ccgcacuguggguacuugcugc

SEQ ID NO: 2538 - RNA, 21 nt, Homo sapiens
uaaagugcugacagugcagau

SEQ ID NO: 2539 - RNA, 23 nt, Homo sapiens
agcagcauuguacagggcuauca

SEQ ID NO: 2540 - RNA, 22 nt, Homo sapiens
caaauucguaucuaggggaaua

SEQ ID NO: 2541 - RNA, 23 nt, Homo sapiens
uacccuguagauccgaauuugug

SEQ ID NO: 2542 - RNA, 22 nt, Homo sapiens
acagauucgauucuaggggaau

SEQ ID NO: 2543 - RNA, 23 nt, Homo sapiens
uacccuguagaaccgaauuugug

SEQ ID NO: 2544 - RNA, 21 nt, Homo sapiens
uugcucacuguucuucccuag

SEQ ID NO: 2545 - RNA, 18 nt, Homo sapiens
cagggucagcugagcaug

SEQ ID NO: 2546 - RNA, 21 nt, Homo sapiens
aagcauucuuucauugguugg

SEQ ID NO: 2547 - RNA, 22 nt, Homo sapiens
uuuccggcucgcgugggugugu

SEQ ID NO: 2548 - RNA, 21 nt, Homo sapiens
ccgucgccgccacccgagccg

SEQ ID NO: 2549 - RNA, 23 nt, Homo sapiens
gagggucuugggagggaugugac

SEQ ID NO: 2550 - RNA, 27 nt, Homo sapiens
cacuguaggugauggugagagugggca

SEQ ID NO: 2551 - RNA, 23 nt, Homo sapiens
ccugcagcgacuugauggcuucc

SEQ ID NO: 2552 - RNA, 22 nt, Homo sapiens
auauacagggggagacucuuau

SEQ ID NO: 2553 - RNA, 22 nt, Homo sapiens
auauacagggggagacucucau

SEQ ID NO: 2554 - RNA, 21 nt, Homo sapiens
agaggauacccuuuguauguu

SEQ ID NO: 2555 - RNA, 23 nt, Homo sapiens
gggaugguagaccggugacgugc

SEQ ID NO: 2556 - RNA, 21 nt, Homo sapiens
uaggacacauggucuacuucu

SEQ ID NO: 2557 - RNA, 22 nt, Homo sapiens
cuccugagccauucugagccuc

SEQ ID NO: 2558 - RNA, 21 nt, Homo sapiens
gugccagcugcagugggggag

SEQ ID NO: 2559 - RNA, 21 nt, Homo sapiens
cccggagccaggaugcagcuc

SEQ ID NO: 2560 - RNA, 21 nt, Homo sapiens
ucguggccuggucuccauuau

SEQ ID NO: 2561 - RNA, 20 nt, Homo sapiens
ucugcaggguuugcuuugag

SEQ ID NO: 2562 - RNA, 21 nt, Homo sapiens
uguucauguagauguuuaagc

SEQ ID NO: 2563 - RNA, 18 nt, Homo sapiens
ucagcuggcccucauuuc

SEQ ID NO: 2564 - RNA, 21 nt, Homo sapiens
uggcagggaggcugggagggg

SEQ ID NO: 2565 - RNA, 20 nt, Homo sapiens
ucacuguucagacaggcgga

SEQ ID NO: 2566 - RNA, 22 nt, Homo sapiens
aacgccauuaucacacuaaaua

SEQ ID NO: 2567 - RNA, 21 nt, Homo sapiens
ccccaccuccucucuccucag

SEQ ID NO: 2568 - RNA, 19 nt, Homo sapiens
gugaggacucgggaggugg

SEQ ID NO: 2569 - RNA, 22 nt, Homo sapiens
ugagccccugugccgcccccag

SEQ ID NO: 2570 - RNA, 22 nt, Homo sapiens
guggguacggcccagugggggg

SEQ ID NO: 2571 - RNA, 22 nt, Homo sapiens
uggagugugacaaugguguuug

SEQ ID NO: 2572 - RNA, 22 nt, Homo sapiens
ucaccagcccuguguucccuag

SEQ ID NO: 2573 - RNA, 26 nt, Homo sapiens
gugagggcaugcaggccuggaugggg

SEQ ID NO: 2574 - RNA, 20 nt, Homo sapiens
cgugccacccuuuuccccag

SEQ ID NO: 2575 - RNA, 17 nt, Homo sapiens
guggggccaggcggugg

SEQ ID NO: 2576 - RNA, 20 nt, Homo sapiens
ucacaccugccucgcccccc

SEQ ID NO: 2577 - RNA, 21 nt, Homo sapiens
gugggcgggggcaggugugug

SEQ ID NO: 2578 - RNA, 23 nt, Homo sapiens
cucucaccacugcccucccacag

SEQ ID NO: 2579 - RNA, 24 nt, Homo sapiens
guggguaggguuugggggagagcg

SEQ ID NO: 2580 - RNA, 20 nt, Homo sapiens
gugucugggcggacagcugc

SEQ ID NO: 2581 - RNA, 22 nt, Homo sapiens
agugggaggccagggcacggca

SEQ ID NO: 2582 - RNA, 20 nt, Homo sapiens
ugagcccuguccucccgcag

SEQ ID NO: 2583 - RNA, 22 nt, Homo sapiens
ucggccugaccacccaccccac

SEQ ID NO: 2584 - RNA, 21 nt, Homo sapiens
ggggggggggggggggggccg

SEQ ID NO: 2585 - RNA, 22 nt, Homo sapiens
ccucuuccccuugucucuccag

SEQ ID NO: 2586 - RNA, 22 nt, Homo sapiens
ugagugacaggggaaaugggga

SEQ ID NO: 2587 - RNA, 21 nt, Homo sapiens
uccuucugcuccgucccccag

SEQ ID NO: 2588 - RNA, 21 nt, Homo sapiens
cgggggcggggccgaagcgcg

SEQ ID NO: 2589 - RNA, 20 nt, Homo sapiens
cuuccucgucugucugcccc

SEQ ID NO: 2590 - RNA, 23 nt, Homo sapiens
gugagugggagccccagugugug

SEQ ID NO: 2591 - RNA, 22 nt, Homo sapiens
aacuggaucaauuauaggagug

SEQ ID NO: 2592 - RNA, 20 nt, Homo sapiens
uaaggcacgcggugaaugcc

SEQ ID NO: 2593 - RNA, 26 nt, Homo sapiens
aaguaguugguuuguaugagaugguu

SEQ ID NO: 2594 - RNA, 21 nt, Homo sapiens
aagugaucuaaaggccuacau

SEQ ID NO: 2595 - RNA, 22 nt, Homo sapiens
ucagaugaucuaaaggccuaua

SEQ ID NO: 2596 - RNA, 21 nt, Homo sapiens
uaggccuuuagaucacuuaaa

SEQ ID NO: 2597 - RNA, 22 nt, Homo sapiens
cguguucacagcggaccuugau

SEQ ID NO: 2598 - RNA, 19 nt, Homo sapiens
aauggauuuuuggagcagg

SEQ ID NO: 2599 - RNA, 24 nt, Homo sapiens
ccccgggaacgucgagacuggagc

SEQ ID NO: 2600 - RNA, 22 nt, Homo sapiens
acccgucccguucguccccgga

SEQ ID NO: 2601 - RNA, 27 nt, Homo sapiens
accuucuuguauaagcacugugcuaaa

SEQ ID NO: 2602 - RNA, 22 nt, Homo sapiens
acgcccuucccccccuucuuca

SEQ ID NO: 2603 - RNA, 21 nt, Homo sapiens
acggugcuggauguggccuuu

SEQ ID NO: 2604 - RNA, 21 nt, Homo sapiens
acucuagcugccaaaggcgcu

SEQ ID NO: 2605 - RNA, 22 nt, Homo sapiens
agaaggaaauugaauucauuua

SEQ ID NO: 2606 - RNA, 21 nt, Homo sapiens
agagaagaagaucagccugca

SEQ ID NO: 2607 - RNA, 24 nt, Homo sapiens
agccuggaagcuggagccugcagu

SEQ ID NO: 2608 - RNA, 23 nt, Homo sapiens
aggaugagcaaagaaaguagauu

SEQ ID NO: 2609 - RNA, 22 nt, Homo sapiens
aaccacuuucuuugcucaucca

SEQ ID NO: 2610 - RNA, 22 nt, Homo sapiens
cggaugagcaaagaaagugguu

SEQ ID NO: 2611 - RNA, 22 nt, Homo sapiens
aggcauugacuucucacuagcu

SEQ ID NO: 2612 - RNA, 21 nt, Homo sapiens
agugaaugauggguucugacc

SEQ ID NO: 2613 - RNA, 21 nt, Homo sapiens
aguuaggauuaggucguggaa

SEQ ID NO: 2614 - RNA, 22 nt, Homo sapiens
acaggugagguucuugggagcc

SEQ ID NO: 2615 - RNA, 24 nt, Homo sapiens
ucccugagacccuuuaaccuguga

SEQ ID NO: 2616 - RNA, 22 nt, Homo sapiens
acggguuaggcucuugggagcu

SEQ ID NO: 2617 - RNA, 22 nt, Homo sapiens
ucacaagucaggcucuugggac

SEQ ID NO: 2618 - RNA, 22 nt, Homo sapiens
ucccugagacccuaacuuguga

SEQ ID NO: 2619 - RNA, 18 nt, Homo sapiens
aucccaccucugccacca

SEQ ID NO: 2620 - RNA, 19 nt, Homo sapiens
aucccaccacugccaccau

SEQ ID NO: 2621 - RNA, 19 nt, Homo sapiens
auggauaaggcuuuggcuu

SEQ ID NO: 2622 - RNA, 22 nt, Homo sapiens
augggugaauuuguagaaggau

SEQ ID NO: 2623 - RNA, 22 nt, Homo sapiens
augguacccuggcauacugagu

SEQ ID NO: 2624 - RNA, 22 nt, Homo sapiens
ucguaccgugaguaauaaugcg

SEQ ID NO: 2625 - RNA, 23 nt, Homo sapiens
caagucuuauuugagcaccuguu

SEQ ID NO: 2626 - RNA, 22 nt, Homo sapiens
caggauguggucaaguguuguu

SEQ ID NO: 2627 - RNA, 21 nt, Homo sapiens
cauuauuacuuuugguacgcg

SEQ ID NO: 2628 - RNA, 23 nt, Homo sapiens
ccucagggcuguagaacagggcu

SEQ ID NO: 2629 - RNA, 21 nt, Homo sapiens
ccuguugaaguguaaucccca

SEQ ID NO: 2630 - RNA, 18 nt, Homo sapiens
cgggcguggugguggggg

SEQ ID NO: 2631 - RNA, 20 nt, Homo sapiens
cgggcgugguggugggggug

SEQ ID NO: 2632 - RNA, 22 nt, Homo sapiens
cuggacugagccgugcuacugg

SEQ ID NO: 2633 - RNA, 22 nt, Homo sapiens
cuggacugagccaugcuacugg

SEQ ID NO: 2634 - RNA, 23 nt, Homo sapiens
cuggagauauggaagagcugugu

SEQ ID NO: 2635 - RNA, 22 nt, Homo sapiens
agugccugcuaugugccaggca

SEQ ID NO: 2636 - RNA, 22 nt, Homo sapiens
cuuggcaccuagcaagcacuca

SEQ ID NO: 2637 - RNA, 26 nt, Homo sapiens
gaugaugauggcagcaaauucugaaa

SEQ ID NO: 2638 - RNA, 25 nt, Homo sapiens
gggcgacaaagcaagacucuuucuu

SEQ ID NO: 2639 - RNA, 22 nt, Homo sapiens
ggcgacaaaacgagacccuguc

SEQ ID NO: 2640 - RNA, 25 nt, Homo sapiens
gaacccaugagguugaggcugcagu

SEQ ID NO: 2641 - RNA, 22 nt, Homo sapiens
uugcuugaacccaggaagugga

SEQ ID NO: 2642 - RNA, 19 nt, Homo sapiens
ggagauggagguugcagug

SEQ ID NO: 2643 - RNA, 21 nt, Homo sapiens
accacugcacuccagccugag

SEQ ID NO: 2644 - RNA, 22 nt, Homo sapiens
ggugguugaggcugcaguaagu

SEQ ID NO: 2645 - RNA, 22 nt, Homo sapiens
ucggauccgucugagcuuggcu

SEQ ID NO: 2646 - RNA, 17 nt, Homo sapiens
gugggggagaggcuguc

SEQ ID NO: 2647 - RNA, 22 nt, Homo sapiens
cugaagcucagagggcucugau

SEQ ID NO: 2648 - RNA, 20 nt, Homo sapiens
uaaagagcccuguggagaca

SEQ ID NO: 2649 - RNA, 22 nt, Homo sapiens
uacguagauauauauguauuuu

SEQ ID NO: 2650 - RNA, 24 nt, Homo sapiens
aaauauauauauauauguacguau

SEQ ID NO: 2651 - RNA, 22 nt, Homo sapiens
uaguacugugcauaucaucuau

SEQ ID NO: 2652 - RNA, 17 nt, Homo sapiens
ucauauugcuucuuucu

SEQ ID NO: 2653 - RNA, 21 nt, Homo sapiens
ucacagugaaccggucucuuu

SEQ ID NO: 2654 - RNA, 17 nt, Homo sapiens
ucgccuccuccucuccc

SEQ ID NO: 2655 - RNA, 20 nt, Homo sapiens
ucguuugccuuuuucugcuu

SEQ ID NO: 2656 - RNA, 22 nt, Homo sapiens
ucuacaaaggaaagcgcuuucu

SEQ ID NO: 2657 - RNA, 22 nt, Homo sapiens
ucuauacagacccuggcuuuuc

SEQ ID NO: 2658 - RNA, 22 nt, Homo sapiens
ucugggcaacaaagugagaccu

SEQ ID NO: 2659 - RNA, 21 nt, Homo sapiens
gaucucacuuuguugcccagg

SEQ ID NO: 2660 - RNA, 21 nt, Homo sapiens
ugcaggaccaagaugagcccu

SEQ ID NO: 2661 - RNA, 22 nt, Homo sapiens
ugcuggaucagugguucgaguc

SEQ ID NO: 2662 - RNA, 21 nt, Homo sapiens
uggacugcccugaucuggaga

SEQ ID NO: 2663 - RNA, 23 nt, Homo sapiens
uggaguccaggaaucugcauuuu

SEQ ID NO: 2664 - RNA, 19 nt, Homo sapiens
uggauuuuuggaucaggga

SEQ ID NO: 2665 - RNA, 24 nt, Homo sapiens
uggcccugacugaagaccagcagu

SEQ ID NO: 2666 - RNA, 22 nt, Homo sapiens
aagcccuuaccccaaaaaguau

SEQ ID NO: 2667 - RNA, 20 nt, Homo sapiens
ucgcgccccggcucccguuc

SEQ ID NO: 2668 - RNA, 22 nt, Homo sapiens
aagcccuuaccccaaaaagcau

SEQ ID NO: 2669 - RNA, 25 nt, Homo sapiens
ugggaacggguuccggcagacgcug

SEQ ID NO: 2670 - RNA, 22 nt, Homo sapiens
uggguggucuggagauuugugc

SEQ ID NO: 2671 - RNA, 22 nt, Homo sapiens
ugugagguuggcauuguugucu

SEQ ID NO: 2672 - RNA, 21 nt, Homo sapiens
uuaggccgcagaucuggguga

SEQ ID NO: 2673 - RNA, 22 nt, Homo sapiens
aauaggccacggaucugggcaa

SEQ ID NO: 2674 - RNA, 21 nt, Homo sapiens
cacccagaucugcggccuaau

SEQ ID NO: 2675 - RNA, 21 nt, Homo sapiens
cuuuuugcggucugggcuugc

SEQ ID NO: 2676 - RNA, 22 nt, Homo sapiens
uuagggcccuggcuccaucucc

SEQ ID NO: 2677 - RNA, 17 nt, Homo sapiens
uucaaguaauucaggug

SEQ ID NO: 2678 - RNA, 22 nt, Homo sapiens
uucauucggcuguccagaugua

SEQ ID NO: 2679 - RNA, 22 nt, Homo sapiens
uucuggaauucugugugaggga

SEQ ID NO: 2680 - RNA, 24 nt, Homo sapiens
uugcagcugccugggagugacuuc

SEQ ID NO: 2681 - RNA, 21 nt, Homo sapiens
uugggacauacuuaugcuaaa

SEQ ID NO: 2682 - RNA, 22 nt, Homo sapiens
uuuagagacggggucuugcucu

SEQ ID NO: 2683 - RNA, 22 nt, Homo sapiens
ucucacuguagccucgaacccc

SEQ ID NO: 2684 - RNA, 22 nt, Homo sapiens
uuugaggcuacagugagaugug

SEQ ID NO: 2685 - RNA, 22 nt, Homo sapiens
uuuucaacucuaaugggagaga

SEQ ID NO: 2686 - RNA, 18 nt, Homo sapiens
acguuggcucugguggug

SEQ ID NO: 2687 - RNA, 22 nt, Homo sapiens
ccaccuccccugcaaacgucca

SEQ ID NO: 2688 - RNA, 22 nt, Homo sapiens
acucggcguggcgucggucgug

SEQ ID NO: 2689 - RNA, 21 nt, Homo sapiens
ucgaccggaccucgaccggcu

SEQ ID NO: 2690 - RNA, 22 nt, Homo sapiens
cagugcaauguuaaaagggcau

SEQ ID NO: 2691 - RNA, 22 nt, Homo sapiens
uucacauugugcuacugucugc

SEQ ID NO: 2692 - RNA, 22 nt, Homo sapiens
cagugcaaugaugaaagggcau

SEQ ID NO: 2693 - RNA, 21 nt, Homo sapiens
acucuuucccuguugcacuac

SEQ ID NO: 2694 - RNA, 18 nt, Homo sapiens
cagggaggugaaugugau

SEQ ID NO: 2695 - RNA, 19 nt, Homo sapiens
gaugaugcugcugaugcug

SEQ ID NO: 2696 - RNA, 22 nt, Homo sapiens
ucaaaacugaggggcauuuucu

SEQ ID NO: 2697 - RNA, 22 nt, Homo sapiens
uaacagucuacagccauggucg

SEQ ID NO: 2698 - RNA, 24 nt, Homo sapiens
ccagacagaauucuaugcacuuuc

SEQ ID NO: 2699 - RNA, 22 nt, Homo sapiens
accguggcuuucgauuguuacu

SEQ ID NO: 2700 - RNA, 22 nt, Homo sapiens
uuugguccccuucaaccagcug

SEQ ID NO: 2701 - RNA, 22 nt, Homo sapiens
uuugguccccuucaaccagcua

SEQ ID NO: 2702 - RNA, 22 nt, Homo sapiens
ugugacugguugaccagagggg

SEQ ID NO: 2703 - RNA, 22 nt, Homo sapiens
cuccuggggcccgcacucucgc

SEQ ID NO: 2704 - RNA, 22 nt, Homo sapiens
uauagggauuggagccguggcg

SEQ ID NO: 2705 - RNA, 23 nt, Homo sapiens
uauggcuuuuuauuccuauguga

SEQ ID NO: 2706 - RNA, 22 nt, Homo sapiens
auguagggcuaaaagccauggg

SEQ ID NO: 2707 - RNA, 23 nt, Homo sapiens
uauggcuuuucauuccuauguga

SEQ ID NO: 2708 - RNA, 22 nt, Homo sapiens
caucaucgucucaaaugagucu

SEQ ID NO: 2709 - RNA, 23 nt, Homo sapiens
acuccauuuguuuugaugaugga

SEQ ID NO: 2710 - RNA, 23 nt, Homo sapiens
uuauugcuuaagaauacgcguag

SEQ ID NO: 2711 - RNA, 22 nt, Homo sapiens
gcuacuucacaacaccagggcc

SEQ ID NO: 2712 - RNA, 22 nt, Homo sapiens
gcuauuucacgacaccaggguu

SEQ ID NO: 2713 - RNA, 23 nt, Homo sapiens
agcugguguugugaaucaggccg

SEQ ID NO: 2714 - RNA, 23 nt, Homo sapiens
uggagacgcggcccuguuggagu

SEQ ID NO: 2715 - RNA, 23 nt, Homo sapiens
ucuacagugcacgugucuccagu

SEQ ID NO: 2716 - RNA, 21 nt, Homo sapiens
uaccacaggguagaaccacgg

SEQ ID NO: 2717 - RNA, 22 nt, Homo sapiens
cagugguuuuacccuaugguag

SEQ ID NO: 2718 - RNA, 22 nt, Homo sapiens
uaacacugucugguaaagaugg

SEQ ID NO: 2719 - RNA, 22 nt, Homo sapiens
caucuuccaguacaguguugga

SEQ ID NO: 2720 - RNA, 23 nt, Homo sapiens
uguaguguuuccuacuuuaugga

SEQ ID NO: 2721 - RNA, 21 nt, Homo sapiens
cauaaaguagaaagcacuacu

SEQ ID NO: 2722 - RNA, 21 nt, Homo sapiens
ugagaugaagcacuguagcuc

SEQ ID NO: 2723 - RNA, 22 nt, Homo sapiens
ggugcagugcugcaucucuggu

SEQ ID NO: 2724 - RNA, 20 nt, Homo sapiens
uacaguauagaugauguacu

SEQ ID NO: 2725 - RNA, 22 nt, Homo sapiens
ggauaucaucauauacuguaag

SEQ ID NO: 2726 - RNA, 22 nt, Homo sapiens
ggauuccuggaaauacuguucu

SEQ ID NO: 2727 - RNA, 23 nt, Homo sapiens
guccaguuuucccaggaaucccu

SEQ ID NO: 2728 - RNA, 21 nt, Homo sapiens
cuccguuugccuguuucgcug

SEQ ID NO: 2729 - RNA, 22 nt, Homo sapiens
cucggcgcggggcgcgggcucc

SEQ ID NO: 2730 - RNA, 22 nt, Homo sapiens
ccucugaaauucaguucuucag

SEQ ID NO: 2731 - RNA, 22 nt, Homo sapiens
ugagaacugaauuccauggguu

SEQ ID NO: 2732 - RNA, 22 nt, Homo sapiens
ugcccuguggacucaguucugg

SEQ ID NO: 2733 - RNA, 22 nt, Homo sapiens
ugagaacugaauuccauaggcu

SEQ ID NO: 2734 - RNA, 21 nt, Homo sapiens
gcccuccgcccgugcaccccg

SEQ ID NO: 2735 - RNA, 22 nt, Homo sapiens
gcccgcguguggagccaggugu

SEQ ID NO: 2736 - RNA, 20 nt, Homo sapiens
guguguggaaaugcuucugc

SEQ ID NO: 2737 - RNA, 22 nt, Homo sapiens
gugugcggaaaugcuucugcua

SEQ ID NO: 2738 - RNA, 22 nt, Homo sapiens
ucagugcacuacagaacuuugu

SEQ ID NO: 2739 - RNA, 22 nt, Homo sapiens
aaaguucugagacacuccgacu

SEQ ID NO: 2740 - RNA, 22 nt, Homo sapiens
ucagugcaucacagaacuuugu

SEQ ID NO: 2741 - RNA, 22 nt, Homo sapiens
aaguucuguuauacacucaggc

SEQ ID NO: 2742 - RNA, 21 nt, Homo sapiens
agggagggacgggggcugugc

SEQ ID NO: 2743 - RNA, 23 nt, Homo sapiens
ucuggcuccgugucuucacuccc

SEQ ID NO: 2744 - RNA, 22 nt, Homo sapiens
cugguacaggccugggggacag

SEQ ID NO: 2745 - RNA, 22 nt, Homo sapiens
ucucccaacccuuguaccagug

SEQ ID NO: 2746 - RNA, 21 nt, Homo sapiens
cuagacugaagcuccuugagg

SEQ ID NO: 2747 - RNA, 21 nt, Homo sapiens
ucgaggagcucacagucuagu

SEQ ID NO: 2748 - RNA, 18 nt, Homo sapiens
ucgaggagcucacagucu

SEQ ID NO: 2749 - RNA, 21 nt, Homo sapiens
ucagugcaugacagaacuugg

SEQ ID NO: 2750 - RNA, 22 nt, Homo sapiens
uugcauagucacaaaagugauc

SEQ ID NO: 2751 - RNA, 22 nt, Homo sapiens
aaaaccgucuaguuacaguugu

SEQ ID NO: 2752 - RNA, 23 nt, Homo sapiens
cggcccgggcugcugcuguuccu

SEQ ID NO: 2753 - RNA, 21 nt, Homo sapiens
uccugcgcgucccagaugccc

SEQ ID NO: 2754 - RNA, 22 nt, Homo sapiens
aaucauacacgguugaccuauu

SEQ ID NO: 2755 - RNA, 22 nt, Homo sapiens
uagguuauccguguugccuucg

SEQ ID NO: 2756 - RNA, 22 nt, Homo sapiens
cuccuacauauuagcauuaaca

SEQ ID NO: 2757 - RNA, 23 nt, Homo sapiens
uuaaugcuaaucgugauaggggu

SEQ ID NO: 2758 - RNA, 20 nt, Homo sapiens
uugggcugggcuggguuggg

SEQ ID NO: 2759 - RNA, 22 nt, Homo sapiens
caggccauauugugcugccuca

SEQ ID NO: 2760 - RNA, 22 nt, Homo sapiens
uagcagcacauaaugguuugug

SEQ ID NO: 2761 - RNA, 22 nt, Homo sapiens
cgaaucauuauuugcugcucua

SEQ ID NO: 2762 - RNA, 22 nt, Homo sapiens
uagcagcacaucaugguuuaca

SEQ ID NO: 2763 - RNA, 22 nt, Homo sapiens
ccaguauuaacugugcugcuga

SEQ ID NO: 2764 - RNA, 22 nt, Homo sapiens
ccaauauuacugugcugcuuua

SEQ ID NO: 2765 - RNA, 22 nt, Homo sapiens
uagcagcacguaaauauuggcg

SEQ ID NO: 2766 - RNA, 22 nt, Homo sapiens
acugcagugaaggcacuuguag

SEQ ID NO: 2767 - RNA, 23 nt, Homo sapiens
caaagugcuuacagugcagguag

SEQ ID NO: 2768 - RNA, 22 nt, Homo sapiens
accacugaccguugacuguacc

SEQ ID NO: 2769 - RNA, 22 nt, Homo sapiens
accaucgaccguugauuguacc

SEQ ID NO: 2770 - RNA, 23 nt, Homo sapiens
aacauucaacgcugucggugagu

SEQ ID NO: 2771 - RNA, 21 nt, Homo sapiens
cucacugaacaaugaaugcaa

SEQ ID NO: 2772 - RNA, 23 nt, Homo sapiens
aacauucauugcugucggugggu

SEQ ID NO: 2773 - RNA, 22 nt, Homo sapiens
aaccaucgaccguugaguggac

SEQ ID NO: 2774 - RNA, 22 nt, Homo sapiens
aacauucaaccugucggugagu

SEQ ID NO: 2775 - RNA, 23 nt, Homo sapiens
aacauucauuguugucggugggu

SEQ ID NO: 2776 - RNA, 21 nt, Homo sapiens
ugguucuagacuugccaacua

SEQ ID NO: 2777 - RNA, 18 nt, Homo sapiens
uccagugcccuccucucc

SEQ ID NO: 2778 - RNA, 24 nt, Homo sapiens
uuuggcaaugguagaacucacacu

SEQ ID NO: 2779 - RNA, 18 nt, Homo sapiens
ugaggcaguagauugaau

SEQ ID NO: 2780 - RNA, 22 nt, Homo sapiens
gugaauuaccgaagggccauaa

SEQ ID NO: 2781 - RNA, 22 nt, Homo sapiens
uauggcacugguagaauucacu

SEQ ID NO: 2782 - RNA, 22 nt, Homo sapiens
uggacggagaacugauaagggu

SEQ ID NO: 2783 - RNA, 22 nt, Homo sapiens
aggggcuggcuuuccucugguc

SEQ ID NO: 2784 - RNA, 22 nt, Homo sapiens
uggagagaaaggcaguuccuga

SEQ ID NO: 2785 - RNA, 22 nt, Homo sapiens
gcccaaaggugaauuuuuuggg

SEQ ID NO: 2786 - RNA, 22 nt, Homo sapiens
caaagaauucuccuuuugggcu

SEQ ID NO: 2787 - RNA, 22 nt, Homo sapiens
ucgugucuuguguugcagccgg

SEQ ID NO: 2788 - RNA, 22 nt, Homo sapiens
ggcuacaacacaggacccgggc

SEQ ID NO: 2789 - RNA, 21 nt, Homo sapiens
cucccacaugcaggguuugca

SEQ ID NO: 2790 - RNA, 21 nt, Homo sapiens
caucccuugcaugguggaggg

SEQ ID NO: 2791 - RNA, 23 nt, Homo sapiens
acugcccuaagugcuccuucugg

SEQ ID NO: 2792 - RNA, 23 nt, Homo sapiens
uaaggugcaucuagugcagauag

SEQ ID NO: 2793 - RNA, 22 nt, Homo sapiens
ugcccuaaaugccccuucuggc

SEQ ID NO: 2794 - RNA, 23 nt, Homo sapiens
uaaggugcaucuagugcaguuag

SEQ ID NO: 2795 - RNA, 21 nt, Homo sapiens
cggcggggacggcgauugguc

SEQ ID NO: 2796 - RNA, 22 nt, Homo sapiens
cgcaggggccgggugcucaccg

SEQ ID NO: 2797 - RNA, 21 nt, Homo sapiens
ugagugccggugccugcccug

SEQ ID NO: 2798 - RNA, 22 nt, Homo sapiens
ugauauguuugauauauuaggu

SEQ ID NO: 2799 - RNA, 21 nt, Homo sapiens
ugauauguuugauauuggguu

SEQ ID NO: 2800 - RNA, 21 nt, Homo sapiens
ccaguccugugccugccgccu

SEQ ID NO: 2801 - RNA, 20 nt, Homo sapiens
caccaggcauuguggucucc

SEQ ID NO: 2802 - RNA, 23 nt, Homo sapiens
ugaguaccgccaugucuguuggg

SEQ ID NO: 2803 - RNA, 22 nt, Homo sapiens
uacccagagcaugcagugugaa

SEQ ID NO: 2804 - RNA, 22 nt, Homo sapiens
ucugcccccuccgcugcugcca

SEQ ID NO: 2805 - RNA, 22 nt, Homo sapiens
gcugcgcuuggauuucgucccc

SEQ ID NO: 2806 - RNA, 22 nt, Homo sapiens
ggaggggucccgcacugggagg

SEQ ID NO: 2807 - RNA, 22 nt, Homo sapiens
cccugugcccggcccacuucug

SEQ ID NO: 2808 - RNA, 20 nt, Homo sapiens
ccccagggcgacgcggcggg

SEQ ID NO: 2809 - RNA, 22 nt, Homo sapiens
accuugccuugcugcccgggcc

SEQ ID NO: 2810 - RNA, 23 nt, Homo sapiens
caacggaaucccaaaagcagcug

SEQ ID NO: 2811 - RNA, 22 nt, Homo sapiens
cugccaauuccauaggucacag

SEQ ID NO: 2812 - RNA, 21 nt, Homo sapiens
cugaccuaugaauugacagcc

SEQ ID NO: 2813 - RNA, 22 nt, Homo sapiens
aacuggccuacaaagucccagu

SEQ ID NO: 2814 - RNA, 22 nt, Homo sapiens
ugggucuuugcgggcgagauga

SEQ ID NO: 2815 - RNA, 22 nt, Homo sapiens
aacuggcccucaaagucccgcu

SEQ ID NO: 2816 - RNA, 22 nt, Homo sapiens
cgggguuuugagggcgagauga

SEQ ID NO: 2817 - RNA, 22 nt, Homo sapiens
ccaguggggcugcuguuaucug

SEQ ID NO: 2818 - RNA, 22 nt, Homo sapiens
uguaacagcaacuccaugugga

SEQ ID NO: 2819 - RNA, 22 nt, Homo sapiens
ccaauauuggcugugcugcucc

SEQ ID NO: 2820 - RNA, 21 nt, Homo sapiens
uagcagcacagaaauauuggc

SEQ ID NO: 2821 - RNA, 22 nt, Homo sapiens
cggcaacaagaaacugccugag

SEQ ID NO: 2822 - RNA, 22 nt, Homo sapiens
uagguaguuucauguuguuggg

SEQ ID NO: 2823 - RNA, 22 nt, Homo sapiens
ucgacagcacgacacugccuuc

SEQ ID NO: 2824 - RNA, 22 nt, Homo sapiens
uagguaguuuccuguuguuggg

SEQ ID NO: 2825 - RNA, 22 nt, Homo sapiens
ucaggccaggcacaguggcuca

SEQ ID NO: 2826 - RNA, 19 nt, Homo sapiens
accgugcaaagguagcaua

SEQ ID NO: 2827 - RNA, 22 nt, Homo sapiens
uucaccaccuucuccacccagc

SEQ ID NO: 2828 - RNA, 23 nt, Homo sapiens
cggguagagagggcagugggagg

SEQ ID NO: 2829 - RNA, 20 nt, Homo sapiens
ccuccugcccuccuugcugu

SEQ ID NO: 2830 - RNA, 22 nt, Homo sapiens
gguccagaggggagauagguuc

SEQ ID NO: 2831 - RNA, 22 nt, Homo sapiens
acaguagucugcacauugguua

SEQ ID NO: 2832 - RNA, 23 nt, Homo sapiens
cccaguguucagacuaccuguuc

SEQ ID NO: 2833 - RNA, 22 nt, Homo sapiens
acaguagucugcacauugguua

SEQ ID NO: 2834 - RNA, 23 nt, Homo sapiens
cccaguguuuagacuaucuguuc

SEQ ID NO: 2835 - RNA, 23 nt, Homo sapiens
ugugcaaaucuaugcaaaacuga

SEQ ID NO: 2836 - RNA, 22 nt, Homo sapiens
aguuuugcauaguugcacuaca

SEQ ID NO: 2837 - RNA, 23 nt, Homo sapiens
aguuuugcagguuugcauccagc

SEQ ID NO: 2838 - RNA, 22 nt, Homo sapiens
aguuuugcagguuugcauuuca

SEQ ID NO: 2839 - RNA, 23 nt, Homo sapiens
ugugcaaauccaugcaaaacuga

SEQ ID NO: 2840 - RNA, 22 nt, Homo sapiens
uaacacugucugguaacgaugu

SEQ ID NO: 2841 - RNA, 22 nt, Homo sapiens
caucuuaccggacagugcugga

SEQ ID NO: 2842 - RNA, 22 nt, Homo sapiens
uaauacugccugguaaugauga

SEQ ID NO: 2843 - RNA, 22 nt, Homo sapiens
caucuuacugggcagcauugga

SEQ ID NO: 2844 - RNA, 23 nt, Homo sapiens
uaauacugccggguaaugaugga

SEQ ID NO: 2845 - RNA, 22 nt, Homo sapiens
cgucuuacccagcaguguuugg

SEQ ID NO: 2846 - RNA, 20 nt, Homo sapiens
agagguauagggcaugggaa

SEQ ID NO: 2847 - RNA, 22 nt, Homo sapiens
uuccuaugcauauacuucuuug

SEQ ID NO: 2848 - RNA, 22 nt, Homo sapiens
gugaaauguuuaggaccacuag

SEQ ID NO: 2849 - RNA, 23 nt, Homo sapiens
uugaacuguuaagaaccacugga

SEQ ID NO: 2850 - RNA, 22 nt, Homo sapiens
uagugguccuaaacauuucaca

SEQ ID NO: 2851 - RNA, 21 nt, Homo sapiens
gcugggaaggcaaagggacgu

SEQ ID NO: 2852 - RNA, 22 nt, Homo sapiens
uucccuuugucauccuaugccu

SEQ ID NO: 2853 - RNA, 20 nt, Homo sapiens
uguuuugauaacaguaaugu

SEQ ID NO: 2854 - RNA, 23 nt, Homo sapiens
guguuaauuaaaccucuauuuac

SEQ ID NO: 2855 - RNA, 21 nt, Homo sapiens
gauuucaguggagugaaguuc

SEQ ID NO: 2856 - RNA, 23 nt, Homo sapiens
cuguaauauaaauuuaauuuauu

SEQ ID NO: 2857 - RNA, 22 nt, Homo sapiens
uccuucauuccaccggagucug

SEQ ID NO: 2858 - RNA, 22 nt, Homo sapiens
uggaauguaaggaagugugugg

SEQ ID NO: 2859 - RNA, 22 nt, Homo sapiens
auaagacgagcaaaaagcuugu

SEQ ID NO: 2860 - RNA, 22 nt, Homo sapiens
auaagacgaacaaaagguuugu

SEQ ID NO: 2861 - RNA, 22 nt, Homo sapiens
acugcauuaugagcacuuaaag

SEQ ID NO: 2862 - RNA, 23 nt, Homo sapiens
uaaagugcuuauagugcagguag

SEQ ID NO: 2863 - RNA, 22 nt, Homo sapiens
acuguaguaugggcacuuccag

SEQ ID NO: 2864 - RNA, 23 nt, Homo sapiens
caaagugcucauagugcagguag

SEQ ID NO: 2865 - RNA, 22 nt, Homo sapiens
cugugcgugugacagcggcuga

SEQ ID NO: 2866 - RNA, 22 nt, Homo sapiens
uuggggaaacggccgcugagug

SEQ ID NO: 2867 - RNA, 21 nt, Homo sapiens
auuugugcuuggcucugucac

SEQ ID NO: 2868 - RNA, 21 nt, Homo sapiens
gcagggacagcaaaggggugc

SEQ ID NO: 2869 - RNA, 21 nt, Homo sapiens
cgagccucaagcaagggacuu

SEQ ID NO: 2870 - RNA, 22 nt, Homo sapiens
uagucccuuccuugaagcgguc

SEQ ID NO: 2871 - RNA, 22 nt, Homo sapiens
caucagaauucauggaggcuag

SEQ ID NO: 2872 - RNA, 22 nt, Homo sapiens
agcuuccaugacuccugaugga

SEQ ID NO: 2873 - RNA, 22 nt, Homo sapiens
uucccuuugucauccuucgccu

SEQ ID NO: 2874 - RNA, 21 nt, Homo sapiens
ccucccaugccaagaacuccc

SEQ ID NO: 2875 - RNA, 21 nt, Homo sapiens
gguucuuagcauaggaggucu

SEQ ID NO: 2876 - RNA, 21 nt, Homo sapiens
uguucucuuugccaaggacag

SEQ ID NO: 2877 - RNA, 21 nt, Homo sapiens
uaacagucuccagucacggcc

SEQ ID NO: 2878 - RNA, 23 nt, Homo sapiens
accuuggcucuagacugcuuacu

SEQ ID NO: 2879 - RNA, 21 nt, Homo sapiens
caacaccagucgaugggcugu

SEQ ID NO: 2880 - RNA, 22 nt, Homo sapiens
acagcaggcacagacaggcagu

SEQ ID NO: 2881 - RNA, 22 nt, Homo sapiens
ugccugucuacacuugcugugc

SEQ ID NO: 2882 - RNA, 21 nt, Homo sapiens
augaccuaugaauugacagac

SEQ ID NO: 2883 - RNA, 22 nt, Homo sapiens
uagcuuaucagacugauguuga

SEQ ID NO: 2884 - RNA, 22 nt, Homo sapiens
ucacaguggucucugggauuau

SEQ ID NO: 2885 - RNA, 22 nt, Homo sapiens
uaaucucagcuggcaacuguga

SEQ ID NO: 2886 - RNA, 22 nt, Homo sapiens
aaaucucugcaggcaaauguga

SEQ ID NO: 2887 - RNA, 23 nt, Homo sapiens
uacugcaucaggaacugauugga

SEQ ID NO: 2888 - RNA, 22 nt, Homo sapiens
augguuccgucaagcaccaugg

SEQ ID NO: 2889 - RNA, 22 nt, Homo sapiens
caugguucugucaagcaccgcg

SEQ ID NO: 2890 - RNA, 21 nt, Homo sapiens
uugugcuugaucuaaccaugu

SEQ ID NO: 2891 - RNA, 22 nt, Homo sapiens
agaguugagucuggacgucccg

SEQ ID NO: 2892 - RNA, 22 nt, Homo sapiens
agaauuguggcuggacaucugu

SEQ ID NO: 2893 - RNA, 21 nt, Homo sapiens
ugauuguccaaacgcaauucu

SEQ ID NO: 2894 - RNA, 23 nt, Homo sapiens
agcuacauugucugcuggguuuc

SEQ ID NO: 2895 - RNA, 22 nt, Homo sapiens
accuggcauacaauguagauuu

SEQ ID NO: 2896 - RNA, 21 nt, Homo sapiens
agcuacaucuggcuacugggu

SEQ ID NO: 2897 - RNA, 22 nt, Homo sapiens
cucaguagccaguguagauccu

SEQ ID NO: 2898 - RNA, 22 nt, Homo sapiens
ugucaguuugucaaauacccca

SEQ ID NO: 2899 - RNA, 22 nt, Homo sapiens
cguguauuugacaagcugaguu

SEQ ID NO: 2900 - RNA, 22 nt, Homo sapiens
aagcugccaguugaagaacugu

SEQ ID NO: 2901 - RNA, 23 nt, Homo sapiens
aaaauggugcccuagugacuaca

SEQ ID NO: 2902 - RNA, 21 nt, Homo sapiens
caagucacuagugguuccguu

SEQ ID NO: 2903 - RNA, 22 nt, Homo sapiens
aguucuucaguggcaagcuuua

SEQ ID NO: 2904 - RNA, 22 nt, Homo sapiens
ucugcaagugucagaggcgagg

SEQ ID NO: 2905 - RNA, 21 nt, Homo sapiens
ugacagcgcccugccuggcuc

SEQ ID NO: 2906 - RNA, 24 nt, Homo sapiens
agcgcgggcugagcgcugccaguc

SEQ ID NO: 2907 - RNA, 22 nt, Homo sapiens
gagagcaguguguguugccugg

SEQ ID NO: 2908 - RNA, 22 nt, Homo sapiens
auuguccuugcuguuuggagau

SEQ ID NO: 2909 - RNA, 21 nt, Homo sapiens
auccccagauacaauggacaa

SEQ ID NO: 2910 - RNA, 20 nt, Homo sapiens
uaggaugggggugagaggug

SEQ ID NO: 2911 - RNA, 21 nt, Homo sapiens
aucacauugccagggauuucc

SEQ ID NO: 2912 - RNA, 22 nt, Homo sapiens
gggguuccuggggaugggauuu

SEQ ID NO: 2913 - RNA, 21 nt, Homo sapiens
aucacauugccagggauuacc

SEQ ID NO: 2914 - RNA, 22 nt, Homo sapiens
uggguuccuggcaugcugauuu

SEQ ID NO: 2915 - RNA, 22 nt, Homo sapiens
aucacauugccagugauuaccc

SEQ ID NO: 2916 - RNA, 22 nt, Homo sapiens
ugccuacugagcugauaucagu

SEQ ID NO: 2917 - RNA, 22 nt, Homo sapiens
ugccuacugagcugaaacacag

SEQ ID NO: 2918 - RNA, 22 nt, Homo sapiens
uggcucaguucagcaggaacag

SEQ ID NO: 2919 - RNA, 22 nt, Homo sapiens
agcagaggcagagaggcucagg

SEQ ID NO: 2920 - RNA, 23 nt, Homo sapiens
ugaggcucuguuagccuuggcuc

SEQ ID NO: 2921 - RNA, 22 nt, Homo sapiens
cauugcacuugucucggucuga

SEQ ID NO: 2922 - RNA, 21 nt, Homo sapiens
aggcggagacuugggcaauug

SEQ ID NO: 2923 - RNA, 22 nt, Homo sapiens
uaucauggaguugguaaagcac

SEQ ID NO: 2924 - RNA, 22 nt, Homo sapiens
guuuuaccaccuccaggagacu

SEQ ID NO: 2925 - RNA, 22 nt, Homo sapiens
cgccucuucagcgcugucuucc

SEQ ID NO: 2926 - RNA, 23 nt, Homo sapiens
caggcagugacuguucagacguc

SEQ ID NO: 2927 - RNA, 22 nt, Homo sapiens
ccuauucuugguuacuugcacg

SEQ ID NO: 2928 - RNA, 22 nt, Homo sapiens
ccuauucuugauuacuuguuuc

SEQ ID NO: 2929 - RNA, 22 nt, Homo sapiens
uucaaguaauccaggauaggcu

SEQ ID NO: 2930 - RNA, 22 nt, Homo sapiens
ccuguucuccauuacuuggcuc

SEQ ID NO: 2931 - RNA, 21 nt, Homo sapiens
uucaaguaauucaggauaggu

SEQ ID NO: 2932 - RNA, 21 nt, Homo sapiens
uucacaguggcuaaguuccgc

SEQ ID NO: 2933 - RNA, 22 nt, Homo sapiens
agggcuuagcugcuugugagca

SEQ ID NO: 2934 - RNA, 21 nt, Homo sapiens
uucacaguggcuaaguucugc

SEQ ID NO: 2935 - RNA, 22 nt, Homo sapiens
agagcuuagcugauuggugaac

SEQ ID NO: 2936 - RNA, 22 nt, Homo sapiens
cacuagauugugagcuccugga

SEQ ID NO: 2937 - RNA, 22 nt, Homo sapiens
aaggagcucacagucuauugag

SEQ ID NO: 2938 - RNA, 19 nt, Homo sapiens
ggggccuggcggugggcgg

SEQ ID NO: 2939 - RNA, 21 nt, Homo sapiens
guuagggccaacaucucuugg

SEQ ID NO: 2940 - RNA, 22 nt, Homo sapiens
gaggguuggguggaggcucucc

SEQ ID NO: 2941 - RNA, 23 nt, Homo sapiens
agaauugcguuuggacaaucagu

SEQ ID NO: 2942 - RNA, 22 nt, Homo sapiens
agauguccagccacaauucucg

SEQ ID NO: 2943 - RNA, 21 nt, Homo sapiens
agggcccccccucaauccugu

SEQ ID NO: 2944 - RNA, 21 nt, Homo sapiens
auguaugugugcaugugcaug

SEQ ID NO: 2945 - RNA, 24 nt, Homo sapiens
agcagaagcagggagguucuccca

SEQ ID NO: 2946 - RNA, 22 nt, Homo sapiens
uaugugggaugguaaaccgcuu

SEQ ID NO: 2947 - RNA, 22 nt, Homo sapiens
ugguuuaccgucccacauacau

SEQ ID NO: 2948 - RNA, 22 nt, Homo sapiens
uagcaccaucugaaaucgguua

SEQ ID NO: 2949 - RNA, 22 nt, Homo sapiens
acugauuucuuuugguguucag

SEQ ID NO: 2950 - RNA, 24 nt, Homo sapiens
gcugguuucauauggugguuuaga

SEQ ID NO: 2951 - RNA, 22 nt, Homo sapiens
cugguuucacaugguggcuuag

SEQ ID NO: 2952 - RNA, 23 nt, Homo sapiens
uagcaccauuugaaaucaguguu

SEQ ID NO: 2953 - RNA, 22 nt, Homo sapiens
uagcaccauuugaaaucgguua

SEQ ID NO: 2954 - RNA, 22 nt, Homo sapiens
ugaccgauuucuccugguguuc

SEQ ID NO: 2955 - RNA, 22 nt, Homo sapiens
uauacaagggcagacucucucu

SEQ ID NO: 2956 - RNA, 23 nt, Homo sapiens
cagugcaauaguauugucaaagc

SEQ ID NO: 2957 - RNA, 22 nt, Homo sapiens
gcucugacuuuauugcacuacu

SEQ ID NO: 2958 - RNA, 23 nt, Homo sapiens
cagugcaaugauauugucaaagc

SEQ ID NO: 2959 - RNA, 23 nt, Homo sapiens
uaagugcuuccauguuuugguga

SEQ ID NO: 2960 - RNA, 23 nt, Homo sapiens
acuuaaacguggauguacuugcu

SEQ ID NO: 2961 - RNA, 23 nt, Homo sapiens
uaagugcuuccauguuuuaguag

SEQ ID NO: 2962 - RNA, 22 nt, Homo sapiens
acuuuaacauggaagugcuuuc

SEQ ID NO: 2963 - RNA, 23 nt, Homo sapiens
uaagugcuuccauguuucagugg

SEQ ID NO: 2964 - RNA, 22 nt, Homo sapiens
uuuaacauggggguaccugcug

SEQ ID NO: 2965 - RNA, 23 nt, Homo sapiens
uaagugcuuccauguuugagugu

SEQ ID NO: 2966 - RNA, 22 nt, Homo sapiens
acuuuaacauggaggcacuugc

SEQ ID NO: 2967 - RNA, 17 nt, Homo sapiens
uaagugcuuccaugcuu

SEQ ID NO: 2968 - RNA, 17 nt, Homo sapiens
uaauugcuuccauguuu

SEQ ID NO: 2969 - RNA, 23 nt, Homo sapiens
uugccacacugcaacaccuuaca

SEQ ID NO: 2970 - RNA, 21 nt, Homo sapiens
ucuggcuguuguggugugcaa

SEQ ID NO: 2971 - RNA, 23 nt, Homo sapiens
ucagcaccaggauauuguuggag

SEQ ID NO: 2972 - RNA, 23 nt, Homo sapiens
ucaacaaaaucacugaugcugga

SEQ ID NO: 2973 - RNA, 22 nt, Homo sapiens
gauaucagcucaguaggcaccg

SEQ ID NO: 2974 - RNA, 21 nt, Homo sapiens
guuccugcugaacugagccag

SEQ ID NO: 2975 - RNA, 22 nt, Homo sapiens
cuuucagucggauguuugcagc

SEQ ID NO: 2976 - RNA, 22 nt, Homo sapiens
uguaaacauccucgacuggaag

SEQ ID NO: 2977 - RNA, 22 nt, Homo sapiens
cugggagguggauguuuacuuc

SEQ ID NO: 2978 - RNA, 22 nt, Homo sapiens
uguaaacauccuacacucagcu

SEQ ID NO: 2979 - RNA, 22 nt, Homo sapiens
cugggagaggguuguuuacucc

SEQ ID NO: 2980 - RNA, 22 nt, Homo sapiens
cugggagaaggcuguuuacucu

SEQ ID NO: 2981 - RNA, 23 nt, Homo sapiens
uguaaacauccuacacucucagc

SEQ ID NO: 2982 - RNA, 22 nt, Homo sapiens
cuuucagucagauguuugcugc

SEQ ID NO: 2983 - RNA, 22 nt, Homo sapiens
uguaaacauccccgacuggaag

SEQ ID NO: 2984 - RNA, 22 nt, Homo sapiens
cuuucagucggauguuuacagc

SEQ ID NO: 2985 - RNA, 22 nt, Homo sapiens
uguaaacauccuugacuggaag

SEQ ID NO: 2986 - RNA, 20 nt, Homo sapiens
auauggguuuacuaguuggu

SEQ ID NO: 2987 - RNA, 22 nt, Homo sapiens
ugccuggaacauaguagggacu

SEQ ID NO: 2988 - RNA, 21 nt, Homo sapiens
auaggacucauauagugccag

SEQ ID NO: 2989 - RNA, 20 nt, Homo sapiens
agacacuauacgagucauau

SEQ ID NO: 2990 - RNA, 23 nt, Homo sapiens
ugugacugcauuaugaaaauucu

SEQ ID NO: 2991 - RNA, 20 nt, Homo sapiens
uggcuuuuaacuuugauggc

SEQ ID NO: 2992 - RNA, 21 nt, Homo sapiens
cacagcaaguguagacaggca

SEQ ID NO: 2993 - RNA, 21 nt, Homo sapiens
ccugucugugccugcuguaca

SEQ ID NO: 2994 - RNA, 22 nt, Homo sapiens
uaaauagaguaggcaaaggaca

SEQ ID NO: 2995 - RNA, 22 nt, Homo sapiens
uccuuugccuauucuauuuaag

SEQ ID NO: 2996 - RNA, 22 nt, Homo sapiens
guugggacaagaggacggucuu

SEQ ID NO: 2997 - RNA, 17 nt, Homo sapiens
cagagaauuguuuaauc

SEQ ID NO: 2998 - RNA, 22 nt, Homo sapiens
acuuuccucacucccgugaagu

SEQ ID NO: 2999 - RNA, 21 nt, Homo sapiens
uucgcgggcgaaggcaaaguc

SEQ ID NO: 3000 - RNA, 20 nt, Homo sapiens
uagaggaagcuguggagaga

SEQ ID NO: 3001 - RNA, 22 nt, Homo sapiens
caucuggcauccgucacacaga

SEQ ID NO: 3002 - RNA, 22 nt, Homo sapiens
ugagggacagaugccagaagca

SEQ ID NO: 3003 - RNA, 22 nt, Homo sapiens
uccccuucugcaggccugcugg

SEQ ID NO: 3004 - RNA, 23 nt, Homo sapiens
aucagggcuuguggaaugggaag

SEQ ID NO: 3005 - RNA, 23 nt, Homo sapiens
ucuggcaaguaaaaaacucucau

SEQ ID NO: 3006 - RNA, 22 nt, Homo sapiens
aaacuaaucucuacacugcugc

SEQ ID NO: 3007 - RNA, 22 nt, Homo sapiens
gcaguaguguagagauugguuu

SEQ ID NO: 3008 - RNA, 21 nt, Homo sapiens
gcugcaccggagacuggguaa

SEQ ID NO: 3009 - RNA, 21 nt, Homo sapiens
uacccagucuccggugcagcc

SEQ ID NO: 3010 - RNA, 23 nt, Homo sapiens
ucgaggacugguggaagggccuu

SEQ ID NO: 3011 - RNA, 24 nt, Homo sapiens
uggguagagaaggagcucagagga

SEQ ID NO: 3012 - RNA, 22 nt, Homo sapiens
uaaagaacucuuaaaacccaau

SEQ ID NO: 3013 - RNA, 23 nt, Homo sapiens
ugauggauaaaagacuacauauu

SEQ ID NO: 3014 - RNA, 22 nt, Homo sapiens
ugccuaggcugagacugcagug

SEQ ID NO: 3015 - RNA, 22 nt, Homo sapiens
ggcuggagcgagugcaguggug

SEQ ID NO: 3016 - RNA, 22 nt, Homo sapiens
uggcccaaccuauucaguuagu

SEQ ID NO: 3017 - RNA, 23 nt, Homo sapiens
cugacugaauagguagggucauu

SEQ ID NO: 3018 - RNA, 24 nt, Homo sapiens
ucuguagccugggagcaauggggu

SEQ ID NO: 3019 - RNA, 24 nt, Homo sapiens
uguggacagugagguagagggagu

SEQ ID NO: 3020 - RNA, 23 nt, Homo sapiens
uaggagcucaacagaugccuguu

SEQ ID NO: 3021 - RNA, 22 nt, Homo sapiens
ugcuaugccaacauauugccau

SEQ ID NO: 3022 - RNA, 22 nt, Homo sapiens
agcuuuugggaauucagguagu

SEQ ID NO: 3023 - RNA, 21 nt, Homo sapiens
accugaauuaccaaaagcuuu

SEQ ID NO: 3024 - RNA, 19 nt, Homo sapiens
gagggcggguggaggagga

SEQ ID NO: 3025 - RNA, 22 nt, Homo sapiens
aaggccuuucugaaccuucaga

SEQ ID NO: 3026 - RNA, 25 nt, Homo sapiens
auaacauuguaaagcgcuucuuucg

SEQ ID NO: 3027 - RNA, 22 nt, Homo sapiens
auauaccuguucggucucuuua

SEQ ID NO: 3028 - RNA, 22 nt, Homo sapiens
aggggaccaaagagauauauag

SEQ ID NO: 3029 - RNA, 24 nt, Homo sapiens
agauauuuugaguguuuggaauug

SEQ ID NO: 3030 - RNA, 22 nt, Homo sapiens
aacuccaaacacucaaaacuca

SEQ ID NO: 3031 - RNA, 22 nt, Homo sapiens
caugcuaggauagaaagaaugg

SEQ ID NO: 3032 - RNA, 24 nt, Homo sapiens
gguugggcagugaggaggguguga

SEQ ID NO: 3033 - RNA, 22 nt, Homo sapiens
uggaaaaaacuggugugugcuu

SEQ ID NO: 3034 - RNA, 23 nt, Homo sapiens
uuuguauggauauguguguguau

SEQ ID NO: 3035 - RNA, 22 nt, Homo sapiens
cuggggagauccucgagguugg

SEQ ID NO: 3036 - RNA, 22 nt, Homo sapiens
caaccucgacgaucuccucagc

SEQ ID NO: 3037 - RNA, 21 nt, Homo sapiens
ugaggagaucgucgagguugg

SEQ ID NO: 3038 - RNA, 22 nt, Homo sapiens
caaccucgaggaucuccccagc

SEQ ID NO: 3039 - RNA, 21 nt, Homo sapiens
gguggggcaaugggaucaggu

SEQ ID NO: 3040 - RNA, 22 nt, Homo sapiens
uguguuagaauaggggcaauaa

SEQ ID NO: 3041 - RNA, 22 nt, Homo sapiens
auugccucuguucuaacacaag

SEQ ID NO: 3042 - RNA, 23 nt, Homo sapiens
ggggaaagcgaguagggacauuu

SEQ ID NO: 3043 - RNA, 22 nt, Homo sapiens
cagaaggggaguugggagcaga

SEQ ID NO: 3044 - RNA, 21 nt, Homo sapiens
ccaggcucugcagugggaacu

SEQ ID NO: 3045 - RNA, 18 nt, Homo sapiens
ccaggcucugcaguggga

SEQ ID NO: 3046 - RNA, 21 nt, Homo sapiens
cucccacuuccagaucuuucu

SEQ ID NO: 3047 - RNA, 22 nt, Homo sapiens
aaagaucuggaagugggagaca

SEQ ID NO: 3048 - RNA, 22 nt, Homo sapiens
cugcccuagucuagcugaagcu

SEQ ID NO: 3049 - RNA, 22 nt, Homo sapiens
uucagccaggcuagugcagucu

SEQ ID NO: 3050 - RNA, 22 nt, Homo sapiens
aagggcuuccucucugcaggac

SEQ ID NO: 3051 - RNA, 21 nt, Homo sapiens
ccugcagagaggaagcccuuc

SEQ ID NO: 3052 - RNA, 22 nt, Homo sapiens
uaggauuacaagugucggccac

SEQ ID NO: 3053 - RNA, 21 nt, Homo sapiens
aggcaagaugcuggcauagcu

SEQ ID NO: 3054 - RNA, 22 nt, Homo sapiens
agagcugagacuagaaagccca

SEQ ID NO: 3055 - RNA, 22 nt, Homo sapiens
ggcuuucuagucucagcucucc

SEQ ID NO: 3056 - RNA, 23 nt, Homo sapiens
cugauaagaacagaggcccagau

SEQ ID NO: 3057 - RNA, 21 nt, Homo sapiens
ucccuaccccuccacucccca

SEQ ID NO: 3058 - RNA, 23 nt, Homo sapiens
uuagggaguagaaggguggggag

SEQ ID NO: 3059 - RNA, 22 nt, Homo sapiens
uauaaaaugagggcaguaagac

SEQ ID NO: 3060 - RNA, 22 nt, Homo sapiens
ugugacuuuaagggaaauggcg

SEQ ID NO: 3061 - RNA, 22 nt, Homo sapiens
agguggaugcaaugugaccuca

SEQ ID NO: 3062 - RNA, 23 nt, Homo sapiens
cgcagacaaugccuacuggccua

SEQ ID NO: 3063 - RNA, 22 nt, Homo sapiens
aggauuucagaaauacuggugu

SEQ ID NO: 3064 - RNA, 17 nt, Homo sapiens
gaguucuacagucagac

SEQ ID NO: 3065 - RNA, 22 nt, Homo sapiens
uaggacugugcuuggcacauag

SEQ ID NO: 3066 - RNA, 22 nt, Homo sapiens
cugggguucugagacagacagu

SEQ ID NO: 3067 - RNA, 24 nt, Homo sapiens
agauguauggaaucuguauauauc

SEQ ID NO: 3068 - RNA, 22 nt, Homo sapiens
aaaggaggaaauaggcaggcca

SEQ ID NO: 3069 - RNA, 22 nt, Homo sapiens
ugcccugccuguuuucuccuuu

SEQ ID NO: 3070 - RNA, 23 nt, Homo sapiens
uagugaguuagagaugcagagcc

SEQ ID NO: 3071 - RNA, 22 nt, Homo sapiens
cggggagagaacgcagugacgu

SEQ ID NO: 3072 - RNA, 19 nt, Homo sapiens
acuggccugggacuaccgg

SEQ ID NO: 3073 - RNA, 21 nt, Homo sapiens
ugcacggcacuggggacacgu

SEQ ID NO: 3074 - RNA, 23 nt, Homo sapiens
uguguacacacgugccaggcgcu

SEQ ID NO: 3075 - RNA, 17 nt, Homo sapiens
ggggcgcggccggaucg

SEQ ID NO: 3076 - RNA, 22 nt, Homo sapiens
agaaggggugaaauuuaaacgu

SEQ ID NO: 3077 - RNA, 19 nt, Homo sapiens
uggggcggagcuuccggag

SEQ ID NO: 3078 - RNA, 22 nt, Homo sapiens
uggggcggagcuuccggaggcc

SEQ ID NO: 3079 - RNA, 25 nt, Homo sapiens
cuuccagacgcuccgccccacgucg

SEQ ID NO: 3080 - RNA, 19 nt, Homo sapiens
aucgggcccucggcgccgg

SEQ ID NO: 3081 - RNA, 17 nt, Homo sapiens
gcuucuguaguguaguc

SEQ ID NO: 3082 - RNA, 22 nt, Homo sapiens
gccucucucggagucgcucgga

SEQ ID NO: 3083 - RNA, 23 nt, Homo sapiens
aaagucucgcucucugccccuca

SEQ ID NO: 3084 - RNA, 24 nt, Homo sapiens
ugaggggccucagaccgagcuuuu

SEQ ID NO: 3085 - RNA, 23 nt, Homo sapiens
agaagaaggcggucggucugcgg

SEQ ID NO: 3086 - RNA, 21 nt, Homo sapiens
ucacgcggagagauggcuuug

SEQ ID NO: 3087 - RNA, 22 nt, Homo sapiens
caggcgucugucuacguggcuu

SEQ ID NO: 3088 - RNA, 20 nt, Homo sapiens
uuggccauggggcugcgcgg

SEQ ID NO: 3089 - RNA, 23 nt, Homo sapiens
ccugggcagcguguggcugaagg

SEQ ID NO: 3090 - RNA, 23 nt, Homo sapiens
agaggcuuugugcggauacgggg

SEQ ID NO: 3091 - RNA, 21 nt, Homo sapiens
cccuugggucugaugggguag

SEQ ID NO: 3092 - RNA, 25 nt, Homo sapiens
ugccccaucugugcccuggguagga

SEQ ID NO: 3093 - RNA, 23 nt, Homo sapiens
uguggaagguagacggccagaga

SEQ ID NO: 3094 - RNA, 20 nt, Homo sapiens
ucuggccagcuacgucccca

SEQ ID NO: 3095 - RNA, 23 nt, Homo sapiens
uggggacguagcuggccagacag

SEQ ID NO: 3096 - RNA, 22 nt, Homo sapiens
cucucuggccgucuaccuucca

SEQ ID NO: 3097 - RNA, 23 nt, Homo sapiens
ucugggagguuguagcaguggaa

SEQ ID NO: 3098 - RNA, 22 nt, Homo sapiens
uccugcguaggaucugaggagu

SEQ ID NO: 3099 - RNA, 22 nt, Homo sapiens
agcucugcugcucacuggcagu

SEQ ID NO: 3100 - RNA, 21 nt, Homo sapiens
ggccagccaccaggagggcug

SEQ ID NO: 3101 - RNA, 17 nt, Homo sapiens
cgcgccgggcccggguu

SEQ ID NO: 3102 - RNA, 18 nt, Homo sapiens
cggggcggcaggggccuc

SEQ ID NO: 3103 - RNA, 23 nt, Homo sapiens
ggaggcgcaggcucggaaaggcg

SEQ ID NO: 3104 - RNA, 22 nt, Homo sapiens
guggaguccuggggaauggaga

SEQ ID NO: 3105 - RNA, 23 nt, Homo sapiens
agggacugccuuaggagaaaguu

SEQ ID NO: 3106 - RNA, 22 nt, Homo sapiens
caccuugcgcuacucaggucug

SEQ ID NO: 3107 - RNA, 22 nt, Homo sapiens
aaucugagaaggcgcacaaggu

SEQ ID NO: 3108 - RNA, 17 nt, Homo sapiens
gggauaugaagaaaaau

SEQ ID NO: 3109 - RNA, 22 nt, Homo sapiens
uggaagggagaagagcuuuaau

SEQ ID NO: 3110 - RNA, 22 nt, Homo sapiens
aaaagcuggguugagagggcga

SEQ ID NO: 3111 - RNA, 22 nt, Homo sapiens
aaaagcuggguugagagggcaa

SEQ ID NO: 3112 - RNA, 20 nt, Homo sapiens
aaaagcuggguugagagggu

SEQ ID NO: 3113 - RNA, 19 nt, Homo sapiens
aaaagcuggguugagagga

SEQ ID NO: 3114 - RNA, 18 nt, Homo sapiens
aaagcuggguugagaagg

SEQ ID NO: 3115 - RNA, 21 nt, Homo sapiens
cacauuacacggucgaccucu

SEQ ID NO: 3116 - RNA, 22 nt, Homo sapiens
aggugguccguggcgcguucgc

SEQ ID NO: 3117 - RNA, 22 nt, Homo sapiens
cccaauacacggucgaccucuu

SEQ ID NO: 3118 - RNA, 23 nt, Homo sapiens
agguuguccguggugaguucgca

SEQ ID NO: 3119 - RNA, 22 nt, Homo sapiens
caauuuagugugugugauauuu

SEQ ID NO: 3120 - RNA, 20 nt, Homo sapiens
acugccccaggugcugcugg

SEQ ID NO: 3121 - RNA, 23 nt, Homo sapiens
cgcauccccuagggcauuggugu

SEQ ID NO: 3122 - RNA, 23 nt, Homo sapiens
ccuaguagguguccaguaagugu

SEQ ID NO: 3123 - RNA, 22 nt, Homo sapiens
uauugcacauuacuaaguugca

SEQ ID NO: 3124 - RNA, 20 nt, Homo sapiens
ccucugggcccuuccuccag

SEQ ID NO: 3125 - RNA, 22 nt, Homo sapiens
cuggcccucucugcccuuccgu

SEQ ID NO: 3126 - RNA, 22 nt, Homo sapiens
aacacaccugguuaaccucuuu

SEQ ID NO: 3127 - RNA, 23 nt, Homo sapiens
gcaaagcacacggccugcagaga

SEQ ID NO: 3128 - RNA, 22 nt, Homo sapiens
ucucugggccugugucuuaggc

SEQ ID NO: 3129 - RNA, 21 nt, Homo sapiens
gccccugggccuauccuagaa

SEQ ID NO: 3130 - RNA, 22 nt, Homo sapiens
cuagguauggucccagggaucc

SEQ ID NO: 3131 - RNA, 22 nt, Homo sapiens
uuuuucauuauugcuccugacc

SEQ ID NO: 3132 - RNA, 23 nt, Homo sapiens
ucaagagcaauaacgaaaaaugu

SEQ ID NO: 3133 - RNA, 22 nt, Homo sapiens
cuccuauaugaugccuuucuuc

SEQ ID NO: 3134 - RNA, 21 nt, Homo sapiens
gaacggcuucauacaggaguu

SEQ ID NO: 3135 - RNA, 22 nt, Homo sapiens
uccagcaucagugauuuuguug

SEQ ID NO: 3136 - RNA, 22 nt, Homo sapiens
aacaauauccuggugcugagug

SEQ ID NO: 3137 - RNA, 23 nt, Homo sapiens
ugagcgccucgacgacagagccg

SEQ ID NO: 3138 - RNA, 23 nt, Homo sapiens
ucccuguccuccaggagcucacg

SEQ ID NO: 3139 - RNA, 22 nt, Homo sapiens
caauguuuccacagugcaucac

SEQ ID NO: 3140 - RNA, 21 nt, Homo sapiens
gugcauuguaguugcauugca

SEQ ID NO: 3141 - RNA, 22 nt, Homo sapiens
cagugccucggcagugcagccc

SEQ ID NO: 3142 - RNA, 20 nt, Homo sapiens
gugcauugcuguugcauugc

SEQ ID NO: 3143 - RNA, 22 nt, Homo sapiens
uccgucucaguuacuuuauagc

SEQ ID NO: 3144 - RNA, 22 nt, Homo sapiens
uuauaaagcaaugagacugauu

SEQ ID NO: 3145 - RNA, 23 nt, Homo sapiens
ucucacacagaaaucgcacccgu

SEQ ID NO: 3146 - RNA, 21 nt, Homo sapiens
aggggugcuaucugugauuga

SEQ ID NO: 3147 - RNA, 22 nt, Homo sapiens
gcccugaacgaggggucuggag

SEQ ID NO: 3148 - RNA, 22 nt, Homo sapiens
gcugacuccuaguccagggcuc

SEQ ID NO: 3149 - RNA, 23 nt, Homo sapiens
ugucugcccgcaugccugccucu

SEQ ID NO: 3150 - RNA, 22 nt, Homo sapiens
caaucagcaaguauacugcccu

SEQ ID NO: 3151 - RNA, 22 nt, Homo sapiens
uggcagugucuuagcugguugu

SEQ ID NO: 3152 - RNA, 22 nt, Homo sapiens
caaucacuaacuccacugccau

SEQ ID NO: 3153 - RNA, 23 nt, Homo sapiens
uaggcagugucauuagcugauug

SEQ ID NO: 3154 - RNA, 22 nt, Homo sapiens
aaucacuaaccacacggccagg

SEQ ID NO: 3155 - RNA, 23 nt, Homo sapiens
aggcaguguaguuagcugauugc

SEQ ID NO: 3156 - RNA, 24 nt, Homo sapiens
aacaacaaaaucacuagucuucca

SEQ ID NO: 3157 - RNA, 22 nt, Homo sapiens
agguagacugggauuuguuguu

SEQ ID NO: 3158 - RNA, 22 nt, Homo sapiens
aaacaccauugucacacuccac

SEQ ID NO: 3159 - RNA, 23 nt, Homo sapiens
uuuagugugauaauggcguuuga

SEQ ID NO: 3160 - RNA, 23 nt, Homo sapiens
ccuccguguuaccuguccucuag

SEQ ID NO: 3161 - RNA, 23 nt, Homo sapiens
ugaggauggauagcaaggaagcc

SEQ ID NO: 3162 - RNA, 21 nt, Homo sapiens
aaaauuucuuucacuacuuag

SEQ ID NO: 3163 - RNA, 21 nt, Homo sapiens
uuagugaaggcuauuuuaauu

SEQ ID NO: 3164 - RNA, 20 nt, Homo sapiens
acuguaaacgcuuucugaug

SEQ ID NO: 3165 - RNA, 22 nt, Homo sapiens
gcaugugaugaagcaaaucagu

SEQ ID NO: 3166 - RNA, 24 nt, Homo sapiens
caaagugaugaguaauacuggcug

SEQ ID NO: 3167 - RNA, 20 nt, Homo sapiens
gaaucggaaaggaggcgccg

SEQ ID NO: 3168 - RNA, 21 nt, Homo sapiens
uugugaagaaagaaauucuua

SEQ ID NO: 3169 - RNA, 22 nt, Homo sapiens
aggaggcaucuugagaaaugga

SEQ ID NO: 3170 - RNA, 24 nt, Homo sapiens
acaaaaaaaaaagcccaacccuuc

SEQ ID NO: 3171 - RNA, 22 nt, Homo sapiens
uguuguacuuuuuuuuuuguuc

SEQ ID NO: 3172 - RNA, 23 nt, Homo sapiens
ucccccaggugugauucugauuu

SEQ ID NO: 3173 - RNA, 23 nt, Homo sapiens
uagccuucagaucuugguguuuu

SEQ ID NO: 3174 - RNA, 23 nt, Homo sapiens
ccacuuggaucugaaggcugccc

SEQ ID NO: 3175 - RNA, 21 nt, Homo sapiens
ucucucggcuccucgcggcuc

SEQ ID NO: 3176 - RNA, 22 nt, Homo sapiens
uuaucagaaucuccagggguac

SEQ ID NO: 3177 - RNA, 23 nt, Homo sapiens
cgagggcauuucaugaugcaggc

SEQ ID NO: 3178 - RNA, 22 nt, Homo sapiens
augaagugcacucaugauaugu

SEQ ID NO: 3179 - RNA, 23 nt, Homo sapiens
caucagcacccuauguccuuucu

SEQ ID NO: 3180 - RNA, 22 nt, Homo sapiens
aaagacauaguugcaagauggg

SEQ ID NO: 3181 - RNA, 22 nt, Homo sapiens
ugucuacauuaaugaaaagagc

SEQ ID NO: 3182 - RNA, 22 nt, Homo sapiens
gggaccauccugccugcugugg

SEQ ID NO: 3183 - RNA, 22 nt, Homo sapiens
ucagcaggcaggcuggugcagc

SEQ ID NO: 3184 - RNA, 22 nt, Homo sapiens
ucacccugcaucccgcacccag

SEQ ID NO: 3185 - RNA, 22 nt, Homo sapiens
gugggcugggcugggcugggcc

SEQ ID NO: 3186 - RNA, 20 nt, Homo sapiens
cgcgggucggggucugcagg

SEQ ID NO: 3187 - RNA, 22 nt, Homo sapiens
ucaccugaccucccaugccugu

SEQ ID NO: 3188 - RNA, 22 nt, Homo sapiens
caggcacgggagcucaggugag

SEQ ID NO: 3189 - RNA, 21 nt, Homo sapiens
ucaccugagcucccgugccug

SEQ ID NO: 3190 - RNA, 20 nt, Homo sapiens
aggcaugggaggucagguga

SEQ ID NO: 3191 - RNA, 22 nt, Homo sapiens
aacacaccuauucaaggauuca

SEQ ID NO: 3192 - RNA, 24 nt, Homo sapiens
aauccuuggaaccuaggugugagu

SEQ ID NO: 3193 - RNA, 22 nt, Homo sapiens
aauugcacgguauccaucugua

SEQ ID NO: 3194 - RNA, 22 nt, Homo sapiens
cggguggaucacgaugcaauuu

SEQ ID NO: 3195 - RNA, 22 nt, Homo sapiens
aaaaugaaaugagcccagccca

SEQ ID NO: 3196 - RNA, 21 nt, Homo sapiens
agccgcggggaucgccgaggg

SEQ ID NO: 3197 - RNA, 19 nt, Homo sapiens
agggaccugagugucuaag

SEQ ID NO: 3198 - RNA, 19 nt, Homo sapiens
aggugugucuguagagucc

SEQ ID NO: 3199 - RNA, 24 nt, Homo sapiens
cauagcccggucgcugguacauga

SEQ ID NO: 3200 - RNA, 18 nt, Homo sapiens
cggcuggaggugugagga

SEQ ID NO: 3201 - RNA, 18 nt, Homo sapiens
cuaagaaguugacugaag

SEQ ID NO: 3202 - RNA, 19 nt, Homo sapiens
gacuggacaagcugaggaa

SEQ ID NO: 3203 - RNA, 21 nt, Homo sapiens
gcuugucgcugcgguguugcu

SEQ ID NO: 3204 - RNA, 17 nt, Homo sapiens
ggcgggugcgggggugg

SEQ ID NO: 3205 - RNA, 21 nt, Homo sapiens
ugugucccauuauuggugauu

SEQ ID NO: 3206 - RNA, 22 nt, Homo sapiens
uuuaagaaaacaccauggagau

SEQ ID NO: 3207 - RNA, 21 nt, Homo sapiens
ugaguguugucuacgagggca

SEQ ID NO: 3208 - RNA, 22 nt, Homo sapiens
uaaugccccuaaaaauccuuau

SEQ ID NO: 3209 - RNA, 23 nt, Homo sapiens
agggacuuuugggggcagaugug

SEQ ID NO: 3210 - RNA, 22 nt, Homo sapiens
uaaugccccuaaaaauccuuau

SEQ ID NO: 3211 - RNA, 22 nt, Homo sapiens
agggacuuucaggggcagcugu

SEQ ID NO: 3212 - RNA, 21 nt, Homo sapiens
acugacaggagagcauuuuga

SEQ ID NO: 3213 - RNA, 22 nt, Homo sapiens
ugaccugggacucggacagcug

SEQ ID NO: 3214 - RNA, 24 nt, Homo sapiens
gaaaaugaugaguagugacugaug

SEQ ID NO: 3215 - RNA, 23 nt, Homo sapiens
ugagcaccacacaggccgggcgc

SEQ ID NO: 3216 - RNA, 21 nt, Homo sapiens
gcuggucugcguggugcucgg

SEQ ID NO: 3217 - RNA, 22 nt, Homo sapiens
ucucaggaguaaagacagaguu

SEQ ID NO: 3218 - RNA, 22 nt, Homo sapiens
aacucugucuucacucaugagu

SEQ ID NO: 3219 - RNA, 18 nt, Homo sapiens
agcaggugcggggcggcg

SEQ ID NO: 3220 - RNA, 21 nt, Homo sapiens
cagugcaaguguagaugccga

SEQ ID NO: 3221 - RNA, 22 nt, Homo sapiens
accuuccucuccaugggucuuu

SEQ ID NO: 3222 - RNA, 22 nt, Homo sapiens
aaagacccauugaggagaaggu

SEQ ID NO: 3223 - RNA, 21 nt, Homo sapiens
aauguagagauugaucaaaau

SEQ ID NO: 3224 - RNA, 23 nt, Homo sapiens
acggaauauguauacggaauaua

SEQ ID NO: 3225 - RNA, 24 nt, Homo sapiens
agagcucacagcuguccuucucua

SEQ ID NO: 3226 - RNA, 22 nt, Homo sapiens
aucaaauaaggacuagucugca

SEQ ID NO: 3227 - RNA, 23 nt, Homo sapiens
augagacucauguaaaacaucuu

SEQ ID NO: 3228 - RNA, 21 nt, Homo sapiens
auggaauguauauacggaaua

SEQ ID NO: 3229 - RNA, 22 nt, Homo sapiens
aauugcacuuuagcaaugguga

SEQ ID NO: 3230 - RNA, 22 nt, Homo sapiens
auuguagaaccuaagauuggcc

SEQ ID NO: 3231 - RNA, 22 nt, Homo sapiens
caucucuaaggaacucccccaa

SEQ ID NO: 3232 - RNA, 23 nt, Homo sapiens
uauggggcuucuguagagauuuc

SEQ ID NO: 3233 - RNA, 22 nt, Homo sapiens
acuguugcuaauaugcaacucu

SEQ ID NO: 3234 - RNA, 20 nt, Homo sapiens
ccguguuucccccacgcuuu

SEQ ID NO: 3235 - RNA, 15 nt, Homo sapiens
aggagauccuggguu

SEQ ID NO: 3236 - RNA, 22 nt, Homo sapiens
cucgugggcucuggccacggcc

SEQ ID NO: 3237 - RNA, 22 nt, Homo sapiens
caguggccagagcccugcagug

SEQ ID NO: 3238 - RNA, 22 nt, Homo sapiens
cugcagaguuuguacggaccgg

SEQ ID NO: 3239 - RNA, 20 nt, Homo sapiens
uccguacaaacucugcugug

SEQ ID NO: 3240 - RNA, 22 nt, Homo sapiens
cuuccccccaguaaucuucauc

SEQ ID NO: 3241 - RNA, 23 nt, Homo sapiens
ugaggauauggcagggaagggga

SEQ ID NO: 3242 - RNA, 23 nt, Homo sapiens
uuuugcaugacccugggaguagg

SEQ ID NO: 3243 - RNA, 22 nt, Homo sapiens
gacucacucacaggauugugca

SEQ ID NO: 3244 - RNA, 22 nt, Homo sapiens
acacagugcuucauccacuacu

SEQ ID NO: 3245 - RNA, 22 nt, Homo sapiens
uaguggaugaugcacucugugc

SEQ ID NO: 3246 - RNA, 21 nt, Homo sapiens
ugaugauacagguggagguag

SEQ ID NO: 3247 - RNA, 22 nt, Homo sapiens
cuacuucuaccuguguuaucau

SEQ ID NO: 3248 - RNA, 22 nt, Homo sapiens
ugcgacauuggaaguaguauca

SEQ ID NO: 3249 - RNA, 21 nt, Homo sapiens
uuagaccuaguacacguccuu

SEQ ID NO: 3250 - RNA, 22 nt, Homo sapiens
uuuccuacccuaccugaagacu

SEQ ID NO: 3251 - RNA, 22 nt, Homo sapiens
aucuguaagagaaaguaaauga

SEQ ID NO: 3252 - RNA, 24 nt, Homo sapiens
cccggacaggcguucgugcgacgu

SEQ ID NO: 3253 - RNA, 22 nt, Homo sapiens
uauggaaagacuuugccacucu

SEQ ID NO: 3254 - RNA, 21 nt, Homo sapiens
aguggcaaagucuuuccauau

SEQ ID NO: 3255 - RNA, 22 nt, Homo sapiens
cugggaggugugauaucguggu

SEQ ID NO: 3256 - RNA, 22 nt, Homo sapiens
ugugauaucaugguuccuggga

SEQ ID NO: 3257 - RNA, 22 nt, Homo sapiens
cugggaggugugauauuguggu

SEQ ID NO: 3258 - RNA, 22 nt, Homo sapiens
ugugauaucaugguuccuggga

SEQ ID NO: 3259 - RNA, 22 nt, Homo sapiens
cugggaggugugauauuguggu

SEQ ID NO: 3260 - RNA, 22 nt, Homo sapiens
gggaggugugaucucacacucg

SEQ ID NO: 3261 - RNA, 22 nt, Homo sapiens
ugugauaucaugguuccuggga

SEQ ID NO: 3262 - RNA, 22 nt, Homo sapiens
ugugauaucgugcuuccuggga

SEQ ID NO: 3263 - RNA, 23 nt, Homo sapiens
accuggacccagcguagacaaag

SEQ ID NO: 3264 - RNA, 22 nt, Homo sapiens
accaagucugcgucauccucuc

SEQ ID NO: 3265 - RNA, 23 nt, Homo sapiens
aguggaugauggagacucgguac

SEQ ID NO: 3266 - RNA, 24 nt, Homo sapiens
guuccacacugacacugcagaagu

SEQ ID NO: 3267 - RNA, 24 nt, Homo sapiens
ccugcuggucaggaguggauacug

SEQ ID NO: 3268 - RNA, 21 nt, Homo sapiens
aauaauacaugguugaucuuu

SEQ ID NO: 3269 - RNA, 22 nt, Homo sapiens
agaucgaccguguuauauucgc

SEQ ID NO: 3270 - RNA, 22 nt, Homo sapiens
gccugcugggguggaaccuggu

SEQ ID NO: 3271 - RNA, 20 nt, Homo sapiens
gguauccguuuggggauggu

SEQ ID NO: 3272 - RNA, 22 nt, Homo sapiens
gaaggcagcagugcuccccugu

SEQ ID NO: 3273 - RNA, 23 nt, Homo sapiens
aagugccgccaucuuuugagugu

SEQ ID NO: 3274 - RNA, 20 nt, Homo sapiens
acucaaacugugggggcacu

SEQ ID NO: 3275 - RNA, 23 nt, Homo sapiens
aagugcccccacaguuugagugc

SEQ ID NO: 3276 - RNA, 22 nt, Homo sapiens
acucaaaagauggcggcacuuu

SEQ ID NO: 3277 - RNA, 23 nt, Homo sapiens
aaagugcugcgacauuugagcgu

SEQ ID NO: 3278 - RNA, 23 nt, Homo sapiens
gaagugcuucgauuuuggggugu

SEQ ID NO: 3279 - RNA, 22 nt, Homo sapiens
acucaaaaugggggcgcuuucc

SEQ ID NO: 3280 - RNA, 22 nt, Homo sapiens
cuuaucagauuguauuguaauu

SEQ ID NO: 3281 - RNA, 22 nt, Homo sapiens
uuauaauacaaccugauaagug

SEQ ID NO: 3282 - RNA, 22 nt, Homo sapiens
cuuagcagguuguauuaucauu

SEQ ID NO: 3283 - RNA, 22 nt, Homo sapiens
auauaauacaaccugcuaagug

SEQ ID NO: 3284 - RNA, 22 nt, Homo sapiens
cacuuagcagguuguauuauau

SEQ ID NO: 3285 - RNA, 22 nt, Homo sapiens
auaauacaaccugcuaagugcu

SEQ ID NO: 3286 - RNA, 22 nt, Homo sapiens
uuuguucguucggcucgcguga

SEQ ID NO: 3287 - RNA, 21 nt, Homo sapiens
gguagauuuuccuucuauggu

SEQ ID NO: 3288 - RNA, 21 nt, Homo sapiens
aucauagaggaaaauccacgu

SEQ ID NO: 3289 - RNA, 22 nt, Homo sapiens
guagauucuccuucuaugagua

SEQ ID NO: 3290 - RNA, 22 nt, Homo sapiens
aucauagaggaaaauccauguu

SEQ ID NO: 3291 - RNA, 22 nt, Homo sapiens
cguggauauuccuucuauguuu

SEQ ID NO: 3292 - RNA, 21 nt, Homo sapiens
aacauagaggaaauuccacgu

SEQ ID NO: 3293 - RNA, 21 nt, Homo sapiens
gguggauauuccuucuauguu

SEQ ID NO: 3294 - RNA, 22 nt, Homo sapiens
aucacacaaaggcaacuuuugu

SEQ ID NO: 3295 - RNA, 22 nt, Homo sapiens
agagguugcccuuggugaauuc

SEQ ID NO: 3296 - RNA, 21 nt, Homo sapiens
acuggacuuggagucagaagg

SEQ ID NO: 3297 - RNA, 22 nt, Homo sapiens
cuccugacuccagguccugugu

SEQ ID NO: 3298 - RNA, 19 nt, Homo sapiens
acuggacuuggaggcagaa

SEQ ID NO: 3299 - RNA, 25 nt, Homo sapiens
acuggacuuggagucagaagagugg

SEQ ID NO: 3300 - RNA, 20 nt, Homo sapiens
acuggacuuggagucagaaa

SEQ ID NO: 3301 - RNA, 19 nt, Homo sapiens
acuggacuuggagucagga

SEQ ID NO: 3302 - RNA, 20 nt, Homo sapiens
acuggacuuggagccagaag

SEQ ID NO: 3303 - RNA, 20 nt, Homo sapiens
acugggcuuggagucagaag

SEQ ID NO: 3304 - RNA, 21 nt, Homo sapiens
acuggacuuggugucagaugg

SEQ ID NO: 3305 - RNA, 21 nt, Homo sapiens
acuggacuaggagucagaagg

SEQ ID NO: 3306 - RNA, 19 nt, Homo sapiens
acuggauuuggagccagaa

SEQ ID NO: 3307 - RNA, 22 nt, Homo sapiens
uauguaacaugguccacuaacu

SEQ ID NO: 3308 - RNA, 21 nt, Homo sapiens
ugguagacuauggaacguagg

SEQ ID NO: 3309 - RNA, 22 nt, Homo sapiens
uauguaauaugguccacaucuu

SEQ ID NO: 3310 - RNA, 22 nt, Homo sapiens
ugguugaccauagaacaugcgc

SEQ ID NO: 3311 - RNA, 22 nt, Homo sapiens
uauacaagggcaagcucucugu

SEQ ID NO: 3312 - RNA, 22 nt, Homo sapiens
agcgagguugcccuuuguauau

SEQ ID NO: 3313 - RNA, 21 nt, Homo sapiens
aaucauucacggacaacacuu

SEQ ID NO: 3314 - RNA, 22 nt, Homo sapiens
gaaguuguucgugguggauucg

SEQ ID NO: 3315 - RNA, 22 nt, Homo sapiens
agaucagaaggugauuguggcu

SEQ ID NO: 3316 - RNA, 20 nt, Homo sapiens
auuccuagaaauuguucaua

SEQ ID NO: 3317 - RNA, 22 nt, Homo sapiens
aggugcuccaggcuggcucaca

SEQ ID NO: 3318 - RNA, 22 nt, Homo sapiens
gagcaauguagguagacuguuu

SEQ ID NO: 3319 - RNA, 22 nt, Homo sapiens
uguccucuagggccugcagucu

SEQ ID NO: 3320 - RNA, 20 nt, Homo sapiens
aaaggcauaaaaccaagaca

SEQ ID NO: 3321 - RNA, 22 nt, Homo sapiens
uguguggauccuggaggaggca

SEQ ID NO: 3322 - RNA, 21 nt, Homo sapiens
uaacgcauaauauggacaugu

SEQ ID NO: 3323 - RNA, 22 nt, Homo sapiens
agacaucaagaucagucccaaa

SEQ ID NO: 3324 - RNA, 22 nt, Homo sapiens
uuugggacugaucuugaugucu

SEQ ID NO: 3325 - RNA, 22 nt, Homo sapiens
aaggaaccagaaaaugagaagu

SEQ ID NO: 3326 - RNA, 22 nt, Homo sapiens
uugaggaaaagauggucuuauu

SEQ ID NO: 3327 - RNA, 26 nt, Homo sapiens
aagaggaagaaauggcugguucucag

SEQ ID NO: 3328 - RNA, 20 nt, Homo sapiens
gcucggacugagcagguggg

SEQ ID NO: 3329 - RNA, 21 nt, Homo sapiens
acagggccgcagauggagacu

SEQ ID NO: 3330 - RNA, 21 nt, Homo sapiens
gcagagaacaaaggacucagu

SEQ ID NO: 3331 - RNA, 22 nt, Homo sapiens
acugauuaucuuaacucucuga

SEQ ID NO: 3332 - RNA, 23 nt, Homo sapiens
ucucugaguaccauaugccuugu

SEQ ID NO: 3333 - RNA, 22 nt, Homo sapiens
ucuggccuugacuugacucuuu

SEQ ID NO: 3334 - RNA, 23 nt, Homo sapiens
ucaaggccagaggucccacagca

SEQ ID NO: 3335 - RNA, 22 nt, Homo sapiens
aacuaguaauguuggauuaggg

SEQ ID NO: 3336 - RNA, 22 nt, Homo sapiens
auauguauaugugacugcuacu

SEQ ID NO: 3337 - RNA, 21 nt, Homo sapiens
acuccaguuuuaguucucuug

SEQ ID NO: 3338 - RNA, 22 nt, Homo sapiens
aagagaacugaaaguggagccu

SEQ ID NO: 3339 - RNA, 21 nt, Homo sapiens
uggccaaaaagcaggcagaga

SEQ ID NO: 3340 - RNA, 22 nt, Homo sapiens
cagguagauauuugauaggcau

SEQ ID NO: 3341 - RNA, 21 nt, Homo sapiens
gccuaucacauaucugccugu

SEQ ID NO: 3342 - RNA, 22 nt, Homo sapiens
ggaggaaccuuggagcuucggc

SEQ ID NO: 3343 - RNA, 23 nt, Homo sapiens
gaggcugaugugaguagaccacu

SEQ ID NO: 3344 - RNA, 22 nt, Homo sapiens
ugcucagguugcacagcuggga

SEQ ID NO: 3345 - RNA, 22 nt, Homo sapiens
ucagguguggaaacugaggcag

SEQ ID NO: 3346 - RNA, 22 nt, Homo sapiens
uguagauacgagcaccagccac

SEQ ID NO: 3347 - RNA, 22 nt, Homo sapiens
uaagggguguauggcagaugca

SEQ ID NO: 3348 - RNA, 23 nt, Homo sapiens
acaggcggcuguagcaauggggg

SEQ ID NO: 3349 - RNA, 22 nt, Homo sapiens
aauucccuuguagauaacccgg

SEQ ID NO: 3350 - RNA, 22 nt, Homo sapiens
uacgcgcagaccacaggauguc

SEQ ID NO: 3351 - RNA, 22 nt, Homo sapiens
cagcccggaucccagcccacuu

SEQ ID NO: 3352 - RNA, 20 nt, Homo sapiens
guggguuggggcgggcucug

SEQ ID NO: 3353 - RNA, 22 nt, Homo sapiens
uuacacacaacugaggaucaua

SEQ ID NO: 3354 - RNA, 21 nt, Homo sapiens
uuucagauaacaguauuacau

SEQ ID NO: 3355 - RNA, 22 nt, Homo sapiens
aagcaauacuguuaccugaaau

SEQ ID NO: 3356 - RNA, 23 nt, Homo sapiens
uagcccccaggcuucacuuggcg

SEQ ID NO: 3357 - RNA, 23 nt, Homo sapiens
uucgggcuggccugcugcuccgg

SEQ ID NO: 3358 - RNA, 21 nt, Homo sapiens
ugugcagcaggccaaccgaga

SEQ ID NO: 3359 - RNA, 23 nt, Homo sapiens
agggcauaggagaggguugauau

SEQ ID NO: 3360 - RNA, 20 nt, Homo sapiens
ggcggcggcggaggcggggg

SEQ ID NO: 3361 - RNA, 22 nt, Homo sapiens
cugccagccccguuccagggca

SEQ ID NO: 3362 - RNA, 23 nt, Homo sapiens
acaaaguacagcauuagccuuag

SEQ ID NO: 3363 - RNA, 23 nt, Homo sapiens
aaaggucauuguaagguuaaugc

SEQ ID NO: 3364 - RNA, 22 nt, Homo sapiens
ugaggcuaaugcacuacuucac

SEQ ID NO: 3365 - RNA, 24 nt, Homo sapiens
uauagagagcaggaagauuaaugu

SEQ ID NO: 3366 - RNA, 23 nt, Homo sapiens
gugcuucaucguaauuaaccuua

SEQ ID NO: 3367 - RNA, 24 nt, Homo sapiens
guggaaagcaugcauccagggugu

SEQ ID NO: 3368 - RNA, 22 nt, Homo sapiens
gaauguugcucggugaaccccu

SEQ ID NO: 3369 - RNA, 23 nt, Homo sapiens
agguuacccgagcaacuuugcau

SEQ ID NO: 3370 - RNA, 21 nt, Homo sapiens
aauauaacacagauggccugu

SEQ ID NO: 3371 - RNA, 22 nt, Homo sapiens
uauguaacacgguccacuaacc

SEQ ID NO: 3372 - RNA, 21 nt, Homo sapiens
uaguagaccguauagcguacg

SEQ ID NO: 3373 - RNA, 23 nt, Homo sapiens
acuucaccugguccacuagccgu

SEQ ID NO: 3374 - RNA, 23 nt, Homo sapiens
aucaacagacauuaauugggcgc

SEQ ID NO: 3375 - RNA, 22 nt, Homo sapiens
acuggacuuagggucagaaggc

SEQ ID NO: 3376 - RNA, 23 nt, Homo sapiens
agcucggucugaggccccucagu

SEQ ID NO: 3377 - RNA, 23 nt, Homo sapiens
ugaggggcagagagcgagacuuu

SEQ ID NO: 3378 - RNA, 21 nt, Homo sapiens
caaaacgugaggcgcugcuau

SEQ ID NO: 3379 - RNA, 22 nt, Homo sapiens
cagcagcaauucauguuuugaa

SEQ ID NO: 3380 - RNA, 17 nt, Homo sapiens
ccugagaaaagggccaa

SEQ ID NO: 3381 - RNA, 19 nt, Homo sapiens
ggccacugagucagcacca

SEQ ID NO: 3382 - RNA, 18 nt, Homo sapiens
agggcauguccagggggu

SEQ ID NO: 3383 - RNA, 22 nt, Homo sapiens
aucgggaaugucguguccgccc

SEQ ID NO: 3384 - RNA, 23 nt, Homo sapiens
gccuggagcuacuccaccaucuc

SEQ ID NO: 3385 - RNA, 17 nt, Homo sapiens
caguguucagagaugga

SEQ ID NO: 3386 - RNA, 23 nt, Homo sapiens
aaugacacgaucacucccguuga

SEQ ID NO: 3387 - RNA, 18 nt, Homo sapiens
aucugaccugaugaaggu

SEQ ID NO: 3388 - RNA, 18 nt, Homo sapiens
ccagagguggggacugag

SEQ ID NO: 3389 - RNA, 17 nt, Homo sapiens
ccccgccaccgccuugg

SEQ ID NO: 3390 - RNA, 22 nt, Homo sapiens
caguugggucuaggggucagga

SEQ ID NO: 3391 - RNA, 19 nt, Homo sapiens
cuuggggcauggaguccca

SEQ ID NO: 3392 - RNA, 16 nt, Homo sapiens
aggaaacagggaccca

SEQ ID NO: 3393 - RNA, 17 nt, Homo sapiens
gacauucagacuaccug

SEQ ID NO: 3394 - RNA, 18 nt, Homo sapiens
auucuaagugccuuggcc

SEQ ID NO: 3395 - RNA, 17 nt, Homo sapiens
acucagucauggucauu

SEQ ID NO: 3396 - RNA, 19 nt, Homo sapiens
cugugggcucagcucuggg

SEQ ID NO: 3397 - RNA, 16 nt, Homo sapiens
cuaggaggccuuggcc

SEQ ID NO: 3398 - RNA, 16 nt, Homo sapiens
uccagcucgguggcac

SEQ ID NO: 3399 - RNA, 21 nt, Homo sapiens
ggcuccuccucucaggaugug

SEQ ID NO: 3400 - RNA, 21 nt, Homo sapiens
gcaggcacagacagcccuggc

SEQ ID NO: 3401 - RNA, 20 nt, Homo sapiens
ucagggagucaggggagggc

SEQ ID NO: 3402 - RNA, 19 nt, Homo sapiens
gggggaagaaaaggugggg

SEQ ID NO: 3403 - RNA, 18 nt, Homo sapiens
cauucaacuagugauugu

SEQ ID NO: 3404 - RNA, 18 nt, Homo sapiens
guguucucugauggacag

SEQ ID NO: 3405 - RNA, 18 nt, Homo sapiens
cagcagucccucccccug

SEQ ID NO: 3406 - RNA, 17 nt, Homo sapiens
ccaauuaccacuucuuu

SEQ ID NO: 3407 - RNA, 17 nt, Homo sapiens
cucagugacucaugugc

SEQ ID NO: 3408 - RNA, 21 nt, Homo sapiens
gcaguucugagcacaguacac

SEQ ID NO: 3409 - RNA, 18 nt, Homo sapiens
cuaggggguuugcccuug

SEQ ID NO: 3410 - RNA, 16 nt, Homo sapiens
cucuccucccggcuuc

SEQ ID NO: 3411 - RNA, 21 nt, Homo sapiens
gaguguaguucugagcagagc

SEQ ID NO: 3412 - RNA, 18 nt, Homo sapiens
gggucccggggagggggg

SEQ ID NO: 3413 - RNA, 18 nt, Homo sapiens
uaaaauuugcauccagga

SEQ ID NO: 3414 - RNA, 17 nt, Homo sapiens
uggggcucagcgaguuu

SEQ ID NO: 3415 - RNA, 18 nt, Homo sapiens
gggcucacaucaccccau

SEQ ID NO: 3416 - RNA, 18 nt, Homo sapiens
gcggcgaguccgacucau

SEQ ID NO: 3417 - RNA, 17 nt, Homo sapiens
accccacuccugguacc

SEQ ID NO: 3418 - RNA, 19 nt, Homo sapiens
ucucccuugagggcacuuu

SEQ ID NO: 3419 - RNA, 17 nt, Homo sapiens
uugucugcugaguuucc

SEQ ID NO: 3420 - RNA, 19 nt, Homo sapiens
gcauugugcagggcuauca

SEQ ID NO: 3421 - RNA, 22 nt, Homo sapiens
uaauacugucugguaaaaccgu

SEQ ID NO: 3422 - RNA, 19 nt, Homo sapiens
ugcccuccuuucuucccuc

SEQ ID NO: 3423 - RNA, 16 nt, Homo sapiens
uucagcaggaacagcu

SEQ ID NO: 3424 - RNA, 18 nt, Homo sapiens
ccccugggccggccuugg

SEQ ID NO: 3425 - RNA, 17 nt, Homo sapiens
cagccugacaggaacag

SEQ ID NO: 3426 - RNA, 17 nt, Homo sapiens
gggagucuacagcaggg

SEQ ID NO: 3427 - RNA, 18 nt, Homo sapiens
cagugcaauguuuuccuu

SEQ ID NO: 3428 - RNA, 17 nt, Homo sapiens
augugggcucaggcuca

SEQ ID NO: 3429 - RNA, 16 nt, Homo sapiens
ugccuuccugucugug

SEQ ID NO: 3430 - RNA, 22 nt, Homo sapiens
cugggacaggaggaggaggcag

SEQ ID NO: 3431 - RNA, 18 nt, Homo sapiens
gcuggugacaugagaggc

SEQ ID NO: 3432 - RNA, 18 nt, Homo sapiens
ugggagcuggacuacuuc

SEQ ID NO: 3433 - RNA, 20 nt, Homo sapiens
ucccacuacuucacuuguga

SEQ ID NO: 3434 - RNA, 18 nt, Homo sapiens
ccaguguggcucagcgag

SEQ ID NO: 3435 - RNA, 17 nt, Homo sapiens
uucugagcugaggacag

SEQ ID NO: 3436 - RNA, 17 nt, Homo sapiens
ccggcauguccagggca

SEQ ID NO: 3437 - RNA, 18 nt, Homo sapiens
ccuagacaccuccaguuc

SEQ ID NO: 3438 - RNA, 17 nt, Homo sapiens
uggagagaaaggcagua

SEQ ID NO: 3439 - RNA, 19 nt, Homo sapiens
aauguuuuuuccuguuucc

SEQ ID NO: 3440 - RNA, 18 nt, Homo sapiens
ucccuggaguuucuucuu

SEQ ID NO: 3441 - RNA, 18 nt, Homo sapiens
cuggagucuaggauucca

SEQ ID NO: 3442 - RNA, 16 nt, Homo sapiens
gcagcauucauguccc

SEQ ID NO: 3443 - RNA, 18 nt, Homo sapiens
gaaagagagcugagugug

SEQ ID NO: 3444 - RNA, 19 nt, Homo sapiens
ggccuuguuccugucccca

SEQ ID NO: 3445 - RNA, 20 nt, Homo sapiens
agcccccuggccccaaaccc

SEQ ID NO: 3446 - RNA, 22 nt, Homo sapiens
caggucgucuugcagggcuucu

SEQ ID NO: 3447 - RNA, 18 nt, Homo sapiens
cucugggaaaugggacag

SEQ ID NO: 3448 - RNA, 18 nt, Homo sapiens
ccgcuuucugagcuggac

SEQ ID NO: 3449 - RNA, 21 nt, Homo sapiens
ugucuugcaggccgucaugca

SEQ ID NO: 3450 - RNA, 17 nt, Homo sapiens
ggugaggcuagcuggug

SEQ ID NO: 3451 - RNA, 17 nt, Homo sapiens
acauugccagggaguuu

SEQ ID NO: 3452 - RNA, 17 nt, Homo sapiens
cacuguggguacaugcu

SEQ ID NO: 3453 - RNA, 17 nt, Homo sapiens
ucccugagcaaagccac

SEQ ID NO: 3454 - RNA, 18 nt, Homo sapiens
gggauucuguagcuuccu

SEQ ID NO: 3455 - RNA, 21 nt, Homo sapiens
uuagcgguggaccgcccugcg

SEQ ID NO: 3456 - RNA, 21 nt, Homo sapiens
cugugggcucagcgcgugggg

SEQ ID NO: 3457 - RNA, 18 nt, Homo sapiens
cagccccacagccucaga

SEQ ID NO: 3458 - RNA, 21 nt, Homo sapiens
cuggauggcuccuccaugucu

SEQ ID NO: 3459 - RNA, 20 nt, Homo sapiens
cccugagacccuaaccuuaa

SEQ ID NO: 3460 - RNA, 18 nt, Homo sapiens
uugcacuugucucaguga

SEQ ID NO: 3461 - RNA, 23 nt, Homo sapiens
ucuuggaguaggucauugggugg

SEQ ID NO: 3462 - RNA, 20 nt, Homo sapiens
uguuccucugucucccagac

SEQ ID NO: 3463 - RNA, 19 nt, Homo sapiens
ggcuugcaugggggacugg

SEQ ID NO: 3464 - RNA, 17 nt, Homo sapiens
ccaguuuucccaggauu

SEQ ID NO: 3465 - RNA, 19 nt, Homo sapiens
ccugagacccuaguuccac

SEQ ID NO: 3466 - RNA, 22 nt, Homo sapiens
aucaugaugggcuccucggugu

SEQ ID NO: 3467 - RNA, 19 nt, Homo sapiens
ccucagaucagagccuugc

SEQ ID NO: 3468 - RNA, 18 nt, Homo sapiens
ggugggcuucccggaggg

SEQ ID NO: 3469 - RNA, 18 nt, Homo sapiens
cacugcaggacucagcag

SEQ ID NO: 3470 - RNA, 17 nt, Homo sapiens
ugagggaggagacugca

SEQ ID NO: 3471 - RNA, 18 nt, Homo sapiens
gaggcugaaggaagaugg

SEQ ID NO: 3472 - RNA, 22 nt, Homo sapiens
gucacugaugucuguagcugag

SEQ ID NO: 3473 - RNA, 22 nt, Homo sapiens
accugucuguggaaaggagcua

SEQ ID NO: 3474 - RNA, 21 nt, Homo sapiens
aaaagcaucaggaaguaccca

SEQ ID NO: 3475 - RNA, 21 nt, Homo sapiens
auaggcaccaaaaagcaacaa

SEQ ID NO: 3476 - RNA, 22 nt, Homo sapiens
aguugccuuuuuguucccaugc

SEQ ID NO: 3477 - RNA, 22 nt, Homo sapiens
agaguuaacucaaaauggacua

SEQ ID NO: 3478 - RNA, 22 nt, Homo sapiens
uguugggauucagcaggaccau

SEQ ID NO: 3479 - RNA, 17 nt, Homo sapiens
gaagauggacguacuuu

SEQ ID NO: 3480 - RNA, 21 nt, Homo sapiens
ucugaauagagucugaagagu

SEQ ID NO: 3481 - RNA, 22 nt, Homo sapiens
caaggagacgggaacauggagc

SEQ ID NO: 3482 - RNA, 20 nt, Homo sapiens
aaaagcugggcugagaggcg

SEQ ID NO: 3483 - RNA, 18 nt, Homo sapiens
aggcuggagugagcggag

SEQ ID NO: 3484 - RNA, 22 nt, Homo sapiens
gcgacucugaaaacuagaaggu

SEQ ID NO: 3485 - RNA, 20 nt, Homo sapiens
aaagacucugcaagaugccu

SEQ ID NO: 3486 - RNA, 21 nt, Homo sapiens
acaggagugggggugggacau

SEQ ID NO: 3487 - RNA, 21 nt, Homo sapiens
cgucccaccccccacuccugu

SEQ ID NO: 3488 - RNA, 18 nt, Homo sapiens
aggagaaguaaaguagaa

SEQ ID NO: 3489 - RNA, 22 nt, Homo sapiens
auggccagagcucacacagagg

SEQ ID NO: 3490 - RNA, 21 nt, Homo sapiens
gcaggacaggcagaaguggau

SEQ ID NO: 3491 - RNA, 22 nt, Homo sapiens
cagggcaggaagaaguggacaa

SEQ ID NO: 3492 - RNA, 22 nt, Homo sapiens
guccacuucugccugcccugcc

SEQ ID NO: 3493 - RNA, 21 nt, Homo sapiens
ugggcucaggguacaaagguu

SEQ ID NO: 3494 - RNA, 21 nt, Homo sapiens
cacaggcuuagaaaagacagu

SEQ ID NO: 3495 - RNA, 22 nt, Homo sapiens
gugacugauaccuuggaggcau

SEQ ID NO: 3496 - RNA, 22 nt, Homo sapiens
ugucguggggcuugcuggcuug

SEQ ID NO: 3497 - RNA, 17 nt, Homo sapiens
acagggaggagauugua

SEQ ID NO: 3498 - RNA, 17 nt, Homo sapiens
gccggacaagagggagg

SEQ ID NO: 3499 - RNA, 17 nt, Homo sapiens
uuggaggcguggguuuu

SEQ ID NO: 3500 - RNA, 18 nt, Homo sapiens
cucgaguuggaagaggcg

SEQ ID NO: 3501 - RNA, 21 nt, Homo sapiens
cacggcaaaagaaacaaucca

SEQ ID NO: 3502 - RNA, 22 nt, Homo sapiens
agauuguuucuuuugccgugca

SEQ ID NO: 3503 - RNA, 22 nt, Homo sapiens
cagggcuggcagugacaugggu

SEQ ID NO: 3504 - RNA, 22 nt, Homo sapiens
auuucccugccauucccuuggc

SEQ ID NO: 3505 - RNA, 17 nt, Homo sapiens
ggugggggcuguuguuu

SEQ ID NO: 3506 - RNA, 20 nt, Homo sapiens
ggcuccuuggucuaggggua

SEQ ID NO: 3507 - RNA, 22 nt, Homo sapiens
cgucccggggcugcgcgaggca

SEQ ID NO: 3508 - RNA, 22 nt, Homo sapiens
uggggauuuggagaagugguga

SEQ ID NO: 3509 - RNA, 17 nt, Homo sapiens
ugguagagcugaggaca

SEQ ID NO: 3510 - RNA, 23 nt, Homo sapiens
uugaauucuuggccuuaagugau

SEQ ID NO: 3511 - RNA, 20 nt, Homo sapiens
gagcuuggucuguagcgguu

SEQ ID NO: 3512 - RNA, 20 nt, Homo sapiens
ggauccgagucacggcacca

SEQ ID NO: 3513 - RNA, 17 nt, Homo sapiens
aggguguguguguuuuu

SEQ ID NO: 3514 - RNA, 17 nt, Homo sapiens
ccugguggcuuccuuuu

SEQ ID NO: 3515 - RNA, 22 nt, Homo sapiens
ucacaagguauugacuggcgua

SEQ ID NO: 3516 - RNA, 19 nt, Homo sapiens
agagguagguguggaagaa

SEQ ID NO: 3517 - RNA, 22 nt, Homo sapiens
ccaggaggcggaggagguggag

SEQ ID NO: 3518 - RNA, 22 nt, Homo sapiens
auagugguugugaauuuaccuu

SEQ ID NO: 3519 - RNA, 23 nt, Homo sapiens
gauugagacuaguagggcuaggc

SEQ ID NO: 3520 - RNA, 23 nt, Homo sapiens
ugacacggaggguggcuugggaa

SEQ ID NO: 3521 - RNA, 17 nt, Homo sapiens
gagacugggguggggcc

SEQ ID NO: 3522 - RNA, 21 nt, Homo sapiens
aagguuuggauagaugcaaua

SEQ ID NO: 3523 - RNA, 22 nt, Homo sapiens
cucaaguagucugaccagggga

SEQ ID NO: 3524 - RNA, 18 nt, Homo sapiens
gggugcgggccggcgggg

SEQ ID NO: 3525 - RNA, 22 nt, Homo sapiens
uggcggcgguaguuaugggcuu

SEQ ID NO: 3526 - RNA, 18 nt, Homo sapiens
agagcagaaggaugagau

SEQ ID NO: 3527 - RNA, 22 nt, Homo sapiens
gcucccucuagggucgcucgga

SEQ ID NO: 3528 - RNA, 21 nt, Homo sapiens
uggcaaacguggaagccgaga

SEQ ID NO: 3529 - RNA, 22 nt, Homo sapiens
ggaaagcuaggaggcuguacag

SEQ ID NO: 3530 - RNA, 21 nt, Homo sapiens
gaaagacaguagauuguauag

SEQ ID NO: 3531 - RNA, 22 nt, Homo sapiens
aacuauacaaccuacuaccuca

SEQ ID NO: 3532 - RNA, 22 nt, Homo sapiens
gggaaggcaguagguuguauag

SEQ ID NO: 3533 - RNA, 22 nt, Homo sapiens
aaccacacaaccuacuaccuca

SEQ ID NO: 3534 - RNA, 22 nt, Homo sapiens
aaccauacaaccuacuaccuca

SEQ ID NO: 3535 - RNA, 22 nt, Homo sapiens
agaaaggcagcaggucguauag

SEQ ID NO: 3536 - RNA, 22 nt, Homo sapiens
aacuaugcaaccuacuaccucu

SEQ ID NO: 3537 - RNA, 22 nt, Homo sapiens
ggaaagcuaggaggccguauag

SEQ ID NO: 3538 - RNA, 22 nt, Homo sapiens
aacuauacaaccuccuaccuca

SEQ ID NO: 3539 - RNA, 22 nt, Homo sapiens
gggaaggcaauagauuguauag

SEQ ID NO: 3540 - RNA, 22 nt, Homo sapiens
ggaaagacaguagacuguauag

SEQ ID NO: 3541 - RNA, 22 nt, Homo sapiens
aacuauacaaucuacuaccuca

SEQ ID NO: 3542 - RNA, 21 nt, Homo sapiens
gcaaggcaguggccuguacag

SEQ ID NO: 3543 - RNA, 22 nt, Homo sapiens
aacuguacaaacuacuaccuca

SEQ ID NO: 3544 - RNA, 22 nt, Homo sapiens
agcaaggcaguagcuugcgcag

SEQ ID NO: 3545 - RNA, 22 nt, Homo sapiens
aacagcacaaacuacuaccuca

SEQ ID NO: 3546 - RNA, 22 nt, Homo sapiens
auacauacuucuuuacauucca

SEQ ID NO: 3547 - RNA, 22 nt, Homo sapiens
cauaccuauagauacaagcuug

SEQ ID NO: 3548 - RNA, 22 nt, Homo sapiens
cacaaguucggaucuacggguu

SEQ ID NO: 3549 - RNA, 21 nt, Homo sapiens
uucaguuaucacaguacugua

SEQ ID NO: 3550 - RNA, 22 nt, Homo sapiens
agcaucagcacugugauaacug

SEQ ID NO: 3551 - RNA, 23 nt, Homo sapiens
caaggcagcacuguaaagaagcu

SEQ ID NO: 3552 - RNA, 23 nt, Homo sapiens
ucauagcccuguacaaugcugcu

SEQ ID NO: 3553 - RNA, 23 nt, Homo sapiens
agcagcauuguacagggcuauga

SEQ ID NO: 3554 - RNA, 22 nt, Homo sapiens
uagcacaugcucaaacauccgu

SEQ ID NO: 3555 - RNA, 23 nt, Homo sapiens
accacaggagucugagcauuuga

SEQ ID NO: 3556 - RNA, 22 nt, Homo sapiens
guaagaagugcuuacauugcag

SEQ ID NO: 3557 - RNA, 23 nt, Homo sapiens
cuaccugcacuguaagcacuuuu

SEQ ID NO: 3558 - RNA, 22 nt, Homo sapiens
gcagcaaguacccacagugcgg

SEQ ID NO: 3559 - RNA, 21 nt, Homo sapiens
aucugcacugucagcacuuua

SEQ ID NO: 3560 - RNA, 23 nt, Homo sapiens
ugauagcccuguacaaugcugcu

SEQ ID NO: 3561 - RNA, 22 nt, Homo sapiens
uauuccccuagauacgaauuug

SEQ ID NO: 3562 - RNA, 23 nt, Homo sapiens
cacaaauucggaucuacagggua

SEQ ID NO: 3563 - RNA, 22 nt, Homo sapiens
auuccccuagaaucgaaucugu

SEQ ID NO: 3564 - RNA, 23 nt, Homo sapiens
cacaaauucgguucuacagggua

SEQ ID NO: 3565 - RNA, 21 nt, Homo sapiens
cuagggaagaacagugagcaa

SEQ ID NO: 3566 - RNA, 18 nt, Homo sapiens
caugcucagcugacccug

SEQ ID NO: 3567 - RNA, 21 nt, Homo sapiens
ccaaccaaugaaagaaugcuu

SEQ ID NO: 3568 - RNA, 22 nt, Homo sapiens
acacacccacgcgagccggaaa

SEQ ID NO: 3569 - RNA, 21 nt, Homo sapiens
cggcucggguggcggcgacgg

SEQ ID NO: 3570 - RNA, 23 nt, Homo sapiens
gucacaucccucccaagacccuc

SEQ ID NO: 3571 - RNA, 27 nt, Homo sapiens
ugcccacucucaccaucaccuacagug

SEQ ID NO: 3572 - RNA, 23 nt, Homo sapiens
ggaagccaucaagucgcugcagg

SEQ ID NO: 3573 - RNA, 22 nt, Homo sapiens
auaagagucucccccuguauau

SEQ ID NO: 3574 - RNA, 22 nt, Homo sapiens
augagagucucccccuguauau

SEQ ID NO: 3575 - RNA, 21 nt, Homo sapiens
aacauacaaaggguauccucu

SEQ ID NO: 3576 - RNA, 23 nt, Homo sapiens
gcacgucaccggucuaccauccc

SEQ ID NO: 3577 - RNA, 21 nt, Homo sapiens
agaaguagaccauguguccua

SEQ ID NO: 3578 - RNA, 22 nt, Homo sapiens
gaggcucagaauggcucaggag

SEQ ID NO: 3579 - RNA, 21 nt, Homo sapiens
cucccccacugcagcuggcac

SEQ ID NO: 3580 - RNA, 21 nt, Homo sapiens
gagcugcauccuggcuccggg

SEQ ID NO: 3581 - RNA, 21 nt, Homo sapiens
auaauggagaccaggccacga

SEQ ID NO: 3582 - RNA, 20 nt, Homo sapiens
cucaaagcaaacccugcaga

SEQ ID NO: 3583 - RNA, 21 nt, Homo sapiens
gcuuaaacaucuacaugaaca

SEQ ID NO: 3584 - RNA, 18 nt, Homo sapiens
gaaaugagggccagcuga

SEQ ID NO: 3585 - RNA, 21 nt, Homo sapiens
ccccucccagccucccugcca

SEQ ID NO: 3586 - RNA, 20 nt, Homo sapiens
uccgccugucugaacaguga

SEQ ID NO: 3587 - RNA, 22 nt, Homo sapiens
uauuuagugugauaauggcguu

SEQ ID NO: 3588 - RNA, 21 nt, Homo sapiens
cugaggagagaggaggugggg

SEQ ID NO: 3589 - RNA, 19 nt, Homo sapiens
ccaccucccgaguccucac

SEQ ID NO: 3590 - RNA, 22 nt, Homo sapiens
cugggggcggcacaggggcuca

SEQ ID NO: 3591 - RNA, 22 nt, Homo sapiens
ccccccacugggccguacccac

SEQ ID NO: 3592 - RNA, 22 nt, Homo sapiens
caaacaccauugucacacucca

SEQ ID NO: 3593 - RNA, 22 nt, Homo sapiens
cuagggaacacagggcugguga

SEQ ID NO: 3594 - RNA, 26 nt, Homo sapiens
ccccauccaggccugcaugcccucac

SEQ ID NO: 3595 - RNA, 20 nt, Homo sapiens
cuggggaaaaggguggcacg

SEQ ID NO: 3596 - RNA, 17 nt, Homo sapiens
ccaccgccuggccccac

SEQ ID NO: 3597 - RNA, 20 nt, Homo sapiens
ggggggcgaggcagguguga

SEQ ID NO: 3598 - RNA, 21 nt, Homo sapiens
cacacaccugcccccgcccac

SEQ ID NO: 3599 - RNA, 23 nt, Homo sapiens
cugugggagggcaguggugagag

SEQ ID NO: 3600 - RNA, 24 nt, Homo sapiens
cgcucucccccaaacccuacccac

SEQ ID NO: 3601 - RNA, 20 nt, Homo sapiens
gcagcuguccgcccagacac

SEQ ID NO: 3602 - RNA, 22 nt, Homo sapiens
ugccgugcccuggccucccacu

SEQ ID NO: 3603 - RNA, 20 nt, Homo sapiens
cugcgggaggacagggcuca

SEQ ID NO: 3604 - RNA, 22 nt, Homo sapiens
gugggguggguggucaggccga

SEQ ID NO: 3605 - RNA, 21 nt, Homo sapiens
cggcccccccccccccccccc

SEQ ID NO: 3606 - RNA, 22 nt, Homo sapiens
cuggagagacaaggggaagagg

SEQ ID NO: 3607 - RNA, 22 nt, Homo sapiens
uccccauuuccccugucacuca

SEQ ID NO: 3608 - RNA, 21 nt, Homo sapiens
cugggggacggagcagaagga

SEQ ID NO: 3609 - RNA, 21 nt, Homo sapiens
cgcgcuucggccccgcccccg

SEQ ID NO: 3610 - RNA, 20 nt, Homo sapiens
ggggcagacagacgaggaag

SEQ ID NO: 3611 - RNA, 23 nt, Homo sapiens
cacacacuggggcucccacucac

SEQ ID NO: 3612 - RNA, 22 nt, Homo sapiens
cacuccuauaauugauccaguu

SEQ ID NO: 3613 - RNA, 20 nt, Homo sapiens
ggcauucaccgcgugccuua

SEQ ID NO: 3614 - RNA, 26 nt, Homo sapiens
aaccaucucauacaaaccaacuacuu

SEQ ID NO: 3615 - RNA, 21 nt, Homo sapiens
auguaggccuuuagaucacuu

SEQ ID NO: 3616 - RNA, 22 nt, Homo sapiens
uauaggccuuuagaucaucuga

SEQ ID NO: 3617 - RNA, 21 nt, Homo sapiens
uuuaagugaucuaaaggccua

SEQ ID NO: 3618 - RNA, 22 nt, Homo sapiens
aucaagguccgcugugaacacg

SEQ ID NO: 3619 - RNA, 19 nt, Homo sapiens
ccugcuccaaaaauccauu

SEQ ID NO: 3620 - RNA, 24 nt, Homo sapiens
gcuccagucucgacguucccgggg

SEQ ID NO: 3621 - RNA, 22 nt, Homo sapiens
uccggggacgaacgggacgggu

SEQ ID NO: 3622 - RNA, 27 nt, Homo sapiens
uuuagcacagugcuuauacaagaaggu

SEQ ID NO: 3623 - RNA, 22 nt, Homo sapiens
ugaagaagggggggaagggcgu

SEQ ID NO: 3624 - RNA, 21 nt, Homo sapiens
aaaggccacauccagcaccgu

SEQ ID NO: 3625 - RNA, 21 nt, Homo sapiens
agcgccuuuggcagcuagagu

SEQ ID NO: 3626 - RNA, 22 nt, Homo sapiens
uaaaugaauucaauuuccuucu

SEQ ID NO: 3627 - RNA, 21 nt, Homo sapiens
ugcaggcugaucuucuucucu

SEQ ID NO: 3628 - RNA, 24 nt, Homo sapiens
acugcaggcuccagcuuccaggcu

SEQ ID NO: 3629 - RNA, 23 nt, Homo sapiens
aaucuacuuucuuugcucauccu

SEQ ID NO: 3630 - RNA, 22 nt, Homo sapiens
uggaugagcaaagaaagugguu

SEQ ID NO: 3631 - RNA, 22 nt, Homo sapiens
aaccacuuucuuugcucauccg

SEQ ID NO: 3632 - RNA, 22 nt, Homo sapiens
agcuagugagaagucaaugccu

SEQ ID NO: 3633 - RNA, 21 nt, Homo sapiens
ggucagaacccaucauucacu

SEQ ID NO: 3634 - RNA, 21 nt, Homo sapiens
uuccacgaccuaauccuaacu

SEQ ID NO: 3635 - RNA, 22 nt, Homo sapiens
ggcucccaagaaccucaccugu

SEQ ID NO: 3636 - RNA, 24 nt, Homo sapiens
ucacagguuaaagggucucaggga

SEQ ID NO: 3637 - RNA, 22 nt, Homo sapiens
agcucccaagagccuaacccgu

SEQ ID NO: 3638 - RNA, 22 nt, Homo sapiens
gucccaagagccugacuuguga

SEQ ID NO: 3639 - RNA, 22 nt, Homo sapiens
ucacaaguuagggucucaggga

SEQ ID NO: 3640 - RNA, 18 nt, Homo sapiens
ugguggcagaggugggau

SEQ ID NO: 3641 - RNA, 19 nt, Homo sapiens
augguggcaguggugggau

SEQ ID NO: 3642 - RNA, 19 nt, Homo sapiens
aagccaaagccuuauccau

SEQ ID NO: 3643 - RNA, 22 nt, Homo sapiens
auccuucuacaaauucacccau

SEQ ID NO: 3644 - RNA, 22 nt, Homo sapiens
acucaguaugccaggguaccau

SEQ ID NO: 3645 - RNA, 22 nt, Homo sapiens
cgcauuauuacucacgguacga

SEQ ID NO: 3646 - RNA, 23 nt, Homo sapiens
aacaggugcucaaauaagacuug

SEQ ID NO: 3647 - RNA, 22 nt, Homo sapiens
aacaacacuugaccacauccug

SEQ ID NO: 3648 - RNA, 21 nt, Homo sapiens
cgcguaccaaaaguaauaaug

SEQ ID NO: 3649 - RNA, 23 nt, Homo sapiens
agcccuguucuacagcccugagg

SEQ ID NO: 3650 - RNA, 21 nt, Homo sapiens
uggggauuacacuucaacagg

SEQ ID NO: 3651 - RNA, 18 nt, Homo sapiens
cccccaccaccacgcccg

SEQ ID NO: 3652 - RNA, 20 nt, Homo sapiens
cacccccaccaccacgcccg

SEQ ID NO: 3653 - RNA, 22 nt, Homo sapiens
ccaguagcacggcucaguccag

SEQ ID NO: 3654 - RNA, 22 nt, Homo sapiens
ccaguagcauggcucaguccag

SEQ ID NO: 3655 - RNA, 23 nt, Homo sapiens
acacagcucuuccauaucuccag

SEQ ID NO: 3656 - RNA, 22 nt, Homo sapiens
ugccuggcacauagcaggcacu

SEQ ID NO: 3657 - RNA, 22 nt, Homo sapiens
ugagugcuugcuaggugccaag

SEQ ID NO: 3658 - RNA, 26 nt, Homo sapiens
uuucagaauuugcugccaucaucauc

SEQ ID NO: 3659 - RNA, 25 nt, Homo sapiens
aagaaagagucuugcuuugucgccc

SEQ ID NO: 3660 - RNA, 22 nt, Homo sapiens
gacagggucucguuuugucgcc

SEQ ID NO: 3661 - RNA, 25 nt, Homo sapiens
acugcagccucaaccucauggguuc

SEQ ID NO: 3662 - RNA, 22 nt, Homo sapiens
uccacuuccuggguucaagcaa

SEQ ID NO: 3663 - RNA, 19 nt, Homo sapiens
cacugcaaccuccaucucc

SEQ ID NO: 3664 - RNA, 21 nt, Homo sapiens
cucaggcuggagugcaguggu

SEQ ID NO: 3665 - RNA, 22 nt, Homo sapiens
acuuacugcagccucaaccacc

SEQ ID NO: 3666 - RNA, 22 nt, Homo sapiens
agccaagcucagacggauccga

SEQ ID NO: 3667 - RNA, 17 nt, Homo sapiens
gacagccucucccccac

SEQ ID NO: 3668 - RNA, 22 nt, Homo sapiens
aucagagcccucugagcuucag

SEQ ID NO: 3669 - RNA, 20 nt, Homo sapiens
ugucuccacagggcucuuua

SEQ ID NO: 3670 - RNA, 22 nt, Homo sapiens
aaaauacauauauaucuacgua

SEQ ID NO: 3671 - RNA, 22 nt, Homo sapiens
gcucuuuucauuaauguagaca

SEQ ID NO: 3672 - RNA, 22 nt, Homo sapiens
auagaugauaugcacaguacua

SEQ ID NO: 3673 - RNA, 17 nt, Homo sapiens
agaaagaagcaauauga

SEQ ID NO: 3674 - RNA, 21 nt, Homo sapiens
aaagagaccgguucacuguga

SEQ ID NO: 3675 - RNA, 17 nt, Homo sapiens
gggagaggaggaggcga

SEQ ID NO: 3676 - RNA, 20 nt, Homo sapiens
aagcagaaaaaggcaaacga

SEQ ID NO: 3677 - RNA, 22 nt, Homo sapiens
agaaagcgcuuuccuuuguaga

SEQ ID NO: 3678 - RNA, 22 nt, Homo sapiens
gaaaagccagggucuguauaga

SEQ ID NO: 3679 - RNA, 22 nt, Homo sapiens
aggucucacuuuguugcccaga

SEQ ID NO: 3680 - RNA, 21 nt, Homo sapiens
ccugggcaacaaagugagauc

SEQ ID NO: 3681 - RNA, 21 nt, Homo sapiens
agggcucaucuugguccugca

SEQ ID NO: 3682 - RNA, 22 nt, Homo sapiens
gacucgaaccacugauccagca

SEQ ID NO: 3683 - RNA, 21 nt, Homo sapiens
ucuccagaucagggcagucca

SEQ ID NO: 3684 - RNA, 23 nt, Homo sapiens
aaaaugcagauuccuggacucca

SEQ ID NO: 3685 - RNA, 19 nt, Homo sapiens
ucccugauccaaaaaucca

SEQ ID NO: 3686 - RNA, 24 nt, Homo sapiens
acugcuggucuucagucagggcca

SEQ ID NO: 3687 - RNA, 22 nt, Homo sapiens
auacuuuuugggguaagggcuu

SEQ ID NO: 3688 - RNA, 20 nt, Homo sapiens
gaacgggagccggggcgcga

SEQ ID NO: 3689 - RNA, 22 nt, Homo sapiens
augcuuuuugggguaagggcuu

SEQ ID NO: 3690 - RNA, 25 nt, Homo sapiens
cagcgucugccggaacccguuccca

SEQ ID NO: 3691 - RNA, 22 nt, Homo sapiens
gcacaaaucuccagaccaccca

SEQ ID NO: 3692 - RNA, 22 nt, Homo sapiens
agacaacaaugccaaccucaca

SEQ ID NO: 3693 - RNA, 21 nt, Homo sapiens
ucacccagaucugcggccuaa

SEQ ID NO: 3694 - RNA, 22 nt, Homo sapiens
uugcccagauccguggccuauu

SEQ ID NO: 3695 - RNA, 21 nt, Homo sapiens
auuaggccgcagaucugggug

SEQ ID NO: 3696 - RNA, 21 nt, Homo sapiens
gcaagcccagaccgcaaaaag

SEQ ID NO: 3697 - RNA, 22 nt, Homo sapiens
ggagauggagccagggcccuaa

SEQ ID NO: 3698 - RNA, 17 nt, Homo sapiens
caccugaauuacuugaa

SEQ ID NO: 3699 - RNA, 22 nt, Homo sapiens
uacaucuggacagccgaaugaa

SEQ ID NO: 3700 - RNA, 22 nt, Homo sapiens
ucccucacacagaauuccagaa

SEQ ID NO: 3701 - RNA, 24 nt, Homo sapiens
gaagucacucccaggcagcugcaa

SEQ ID NO: 3702 - RNA, 21 nt, Homo sapiens
uuuagcauaaguaugucccaa

SEQ ID NO: 3703 - RNA, 22 nt, Homo sapiens
agagcaagaccccgucucuaaa

SEQ ID NO: 3704 - RNA, 22 nt, Homo sapiens
gggguucgaggcuacagugaga

SEQ ID NO: 3705 - RNA, 22 nt, Homo sapiens
cacaucucacuguagccucaaa

SEQ ID NO: 3706 - RNA, 22 nt, Homo sapiens
ucucucccauuagaguugaaaa

SEQ ID NO: 3707 - RNA, 18 nt, Homo sapiens
caccaccagagccaacgu

SEQ ID NO: 3708 - RNA, 22 nt, Homo sapiens
uggacguuugcaggggaggugg

SEQ ID NO: 3709 - RNA, 22 nt, Homo sapiens
cacgaccgacgccacgccgagu

SEQ ID NO: 3710 - RNA, 21 nt, Homo sapiens
agccggucgagguccggucga

SEQ ID NO: 3711 - RNA, 22 nt, Homo sapiens
augcccuuuuaacauugcacug

SEQ ID NO: 3712 - RNA, 22 nt, Homo sapiens
gcagacaguagcacaaugugaa

SEQ ID NO: 3713 - RNA, 22 nt, Homo sapiens
augcccuuucaucauugcacug

SEQ ID NO: 3714 - RNA, 21 nt, Homo sapiens
guagugcaacagggaaagagu

SEQ ID NO: 3715 - RNA, 18 nt, Homo sapiens
aucacauucaccucccug

SEQ ID NO: 3716 - RNA, 19 nt, Homo sapiens
cagcaucagcagcaucauc

SEQ ID NO: 3717 - RNA, 22 nt, Homo sapiens
agaaaaugccccucaguuuuga

SEQ ID NO: 3718 - RNA, 22 nt, Homo sapiens
cgaccauggcuguagacuguua

SEQ ID NO: 3719 - RNA, 24 nt, Homo sapiens
gaaagugcauagaauucugucugg

SEQ ID NO: 3720 - RNA, 22 nt, Homo sapiens
aguaacaaucgaaagccacggu

SEQ ID NO: 3721 - RNA, 22 nt, Homo sapiens
cagcugguugaaggggaccaaa

SEQ ID NO: 3722 - RNA, 22 nt, Homo sapiens
uagcugguugaaggggaccaaa

SEQ ID NO: 3723 - RNA, 22 nt, Homo sapiens
ccccucuggucaaccagucaca

SEQ ID NO: 3724 - RNA, 22 nt, Homo sapiens
gcgagagugcgggccccaggag

SEQ ID NO: 3725 - RNA, 22 nt, Homo sapiens
cgccacggcuccaaucccuaua

SEQ ID NO: 3726 - RNA, 23 nt, Homo sapiens
ucacauaggaauaaaaagccaua

SEQ ID NO: 3727 - RNA, 22 nt, Homo sapiens
cccauggcuuuuagcccuacau

SEQ ID NO: 3728 - RNA, 23 nt, Homo sapiens
ucacauaggaaugaaaagccaua

SEQ ID NO: 3729 - RNA, 22 nt, Homo sapiens
agacucauuugagacgaugaug

SEQ ID NO: 3730 - RNA, 23 nt, Homo sapiens
uccaucaucaaaacaaauggagu

SEQ ID NO: 3731 - RNA, 23 nt, Homo sapiens
cuacgcguauucuuaagcaauaa

SEQ ID NO: 3732 - RNA, 22 nt, Homo sapiens
ggcccugguguugugaaguagc

SEQ ID NO: 3733 - RNA, 22 nt, Homo sapiens
aacccuggugucgugaaauagc

SEQ ID NO: 3734 - RNA, 23 nt, Homo sapiens
cggccugauucacaacaccagcu

SEQ ID NO: 3735 - RNA, 23 nt, Homo sapiens
acuccaacagggccgcgucucca

SEQ ID NO: 3736 - RNA, 23 nt, Homo sapiens
acuggagacacgugcacuguaga

SEQ ID NO: 3737 - RNA, 21 nt, Homo sapiens
ccgugguucuacccuguggua

SEQ ID NO: 3738 - RNA, 22 nt, Homo sapiens
cuaccauaggguaaaaccacug

SEQ ID NO: 3739 - RNA, 22 nt, Homo sapiens
ccaucuuuaccagacaguguua

SEQ ID NO: 3740 - RNA, 22 nt, Homo sapiens
uccaacacuguacuggaagaug

SEQ ID NO: 3741 - RNA, 23 nt, Homo sapiens
uccauaaaguaggaaacacuaca

SEQ ID NO: 3742 - RNA, 21 nt, Homo sapiens
aguagugcuuucuacuuuaug

SEQ ID NO: 3743 - RNA, 21 nt, Homo sapiens
gagcuacagugcuucaucuca

SEQ ID NO: 3744 - RNA, 22 nt, Homo sapiens
accagagaugcagcacugcacc

SEQ ID NO: 3745 - RNA, 20 nt, Homo sapiens
aguacaucaucuauacugua

SEQ ID NO: 3746 - RNA, 22 nt, Homo sapiens
cuuacaguauaugaugauaucc

SEQ ID NO: 3747 - RNA, 22 nt, Homo sapiens
agaacaguauuuccaggaaucc

SEQ ID NO: 3748 - RNA, 23 nt, Homo sapiens
agggauuccugggaaaacuggac

SEQ ID NO: 3749 - RNA, 21 nt, Homo sapiens
cagcgaaacaggcaaacggag

SEQ ID NO: 3750 - RNA, 22 nt, Homo sapiens
ggagcccgcgccccgcgccgag

SEQ ID NO: 3751 - RNA, 22 nt, Homo sapiens
cugaagaacugaauuucagagg

SEQ ID NO: 3752 - RNA, 22 nt, Homo sapiens
aacccauggaauucaguucuca

SEQ ID NO: 3753 - RNA, 22 nt, Homo sapiens
ccagaacugaguccacagggca

SEQ ID NO: 3754 - RNA, 22 nt, Homo sapiens
agccuauggaauucaguucuca

SEQ ID NO: 3755 - RNA, 21 nt, Homo sapiens
cggggugcacgggcggagggc

SEQ ID NO: 3756 - RNA, 22 nt, Homo sapiens
acaccuggcuccacacgcgggc

SEQ ID NO: 3757 - RNA, 20 nt, Homo sapiens
gcagaagcauuuccacacac

SEQ ID NO: 3758 - RNA, 22 nt, Homo sapiens
uagcagaagcauuuccgcacac

SEQ ID NO: 3759 - RNA, 22 nt, Homo sapiens
acaaaguucuguagugcacuga

SEQ ID NO: 3760 - RNA, 22 nt, Homo sapiens
agucggagugucucagaacuuu

SEQ ID NO: 3761 - RNA, 22 nt, Homo sapiens
acaaaguucugugaugcacuga

SEQ ID NO: 3762 - RNA, 22 nt, Homo sapiens
gccugaguguauaacagaacuu

SEQ ID NO: 3763 - RNA, 21 nt, Homo sapiens
gcacagcccccgucccucccu

SEQ ID NO: 3764 - RNA, 23 nt, Homo sapiens
gggagugaagacacggagccaga

SEQ ID NO: 3765 - RNA, 22 nt, Homo sapiens
cugucccccaggccuguaccag

SEQ ID NO: 3766 - RNA, 22 nt, Homo sapiens
cacugguacaaggguugggaga

SEQ ID NO: 3767 - RNA, 21 nt, Homo sapiens
ccucaaggagcuucagucuag

SEQ ID NO: 3768 - RNA, 21 nt, Homo sapiens
acuagacugugagcuccucga

SEQ ID NO: 3769 - RNA, 18 nt, Homo sapiens
agacugugagcuccucga

SEQ ID NO: 3770 - RNA, 21 nt, Homo sapiens
ccaaguucugucaugcacuga

SEQ ID NO: 3771 - RNA, 22 nt, Homo sapiens
gaucacuuuugugacuaugcaa

SEQ ID NO: 3772 - RNA, 22 nt, Homo sapiens
acaacuguaacuagacgguuuu

SEQ ID NO: 3773 - RNA, 23 nt, Homo sapiens
aggaacagcagcagcccgggccg

SEQ ID NO: 3774 - RNA, 21 nt, Homo sapiens
gggcaucugggacgcgcagga

SEQ ID NO: 3775 - RNA, 22 nt, Homo sapiens
aauaggucaaccguguaugauu

SEQ ID NO: 3776 - RNA, 22 nt, Homo sapiens
cgaaggcaacacggauaaccua

SEQ ID NO: 3777 - RNA, 22 nt, Homo sapiens
uguuaaugcuaauauguaggag

SEQ ID NO: 3778 - RNA, 23 nt, Homo sapiens
accccuaucacgauuagcauuaa

SEQ ID NO: 3779 - RNA, 20 nt, Homo sapiens
cccaacccagcccagcccaa

SEQ ID NO: 3780 - RNA, 22 nt, Homo sapiens
ugaggcagcacaauauggccug

SEQ ID NO: 3781 - RNA, 22 nt, Homo sapiens
cacaaaccauuaugugcugcua

SEQ ID NO: 3782 - RNA, 22 nt, Homo sapiens
uagagcagcaaauaaugauucg

SEQ ID NO: 3783 - RNA, 22 nt, Homo sapiens
uguaaaccaugaugugcugcua

SEQ ID NO: 3784 - RNA, 22 nt, Homo sapiens
ucagcagcacaguuaauacugg

SEQ ID NO: 3785 - RNA, 22 nt, Homo sapiens
uaaagcagcacaguaauauugg

SEQ ID NO: 3786 - RNA, 22 nt, Homo sapiens
cgccaauauuuacgugcugcua

SEQ ID NO: 3787 - RNA, 22 nt, Homo sapiens
cuacaagugccuucacugcagu

SEQ ID NO: 3788 - RNA, 23 nt, Homo sapiens
cuaccugcacuguaagcacuuug

SEQ ID NO: 3789 - RNA, 22 nt, Homo sapiens
gguacagucaacggucaguggu

SEQ ID NO: 3790 - RNA, 22 nt, Homo sapiens
gguacaaucaacggucgauggu

SEQ ID NO: 3791 - RNA, 23 nt, Homo sapiens
acucaccgacagcguugaauguu

SEQ ID NO: 3792 - RNA, 21 nt, Homo sapiens
uugcauucauuguucagugag

SEQ ID NO: 3793 - RNA, 23 nt, Homo sapiens
acccaccgacagcaaugaauguu

SEQ ID NO: 3794 - RNA, 22 nt, Homo sapiens
guccacucaacggucgaugguu

SEQ ID NO: 3795 - RNA, 22 nt, Homo sapiens
acucaccgacagguugaauguu

SEQ ID NO: 3796 - RNA, 23 nt, Homo sapiens
acccaccgacaacaaugaauguu

SEQ ID NO: 3797 - RNA, 21 nt, Homo sapiens
uaguuggcaagucuagaacca

SEQ ID NO: 3798 - RNA, 18 nt, Homo sapiens
ggagaggagggcacugga

SEQ ID NO: 3799 - RNA, 24 nt, Homo sapiens
agugugaguucuaccauugccaaa

SEQ ID NO: 3800 - RNA, 18 nt, Homo sapiens
auucaaucuacugccuca

SEQ ID NO: 3801 - RNA, 22 nt, Homo sapiens
uuauggcccuucgguaauucac

SEQ ID NO: 3802 - RNA, 22 nt, Homo sapiens
agugaauucuaccagugccaua

SEQ ID NO: 3803 - RNA, 22 nt, Homo sapiens
acccuuaucaguucuccgucca

SEQ ID NO: 3804 - RNA, 22 nt, Homo sapiens
gaccagaggaaagccagccccu

SEQ ID NO: 3805 - RNA, 22 nt, Homo sapiens
ucaggaacugccuuucucucca

SEQ ID NO: 3806 - RNA, 22 nt, Homo sapiens
cccaaaaaauucaccuuugggc

SEQ ID NO: 3807 - RNA, 22 nt, Homo sapiens
agcccaaaaggagaauucuuug

SEQ ID NO: 3808 - RNA, 22 nt, Homo sapiens
ccggcugcaacacaagacacga

SEQ ID NO: 3809 - RNA, 22 nt, Homo sapiens
gcccggguccuguguuguagcc

SEQ ID NO: 3810 - RNA, 21 nt, Homo sapiens
ugcaaacccugcaugugggag

SEQ ID NO: 3811 - RNA, 21 nt, Homo sapiens
cccuccaccaugcaagggaug

SEQ ID NO: 3812 - RNA, 23 nt, Homo sapiens
ccagaaggagcacuuagggcagu

SEQ ID NO: 3813 - RNA, 23 nt, Homo sapiens
cuaucugcacuagaugcaccuua

SEQ ID NO: 3814 - RNA, 22 nt, Homo sapiens
gccagaaggggcauuuagggca

SEQ ID NO: 3815 - RNA, 23 nt, Homo sapiens
cuaacugcacuagaugcaccuua

SEQ ID NO: 3816 - RNA, 21 nt, Homo sapiens
gaccaaucgccguccccgccg

SEQ ID NO: 3817 - RNA, 22 nt, Homo sapiens
cggugagcacccggccccugcg

SEQ ID NO: 3818 - RNA, 21 nt, Homo sapiens
cagggcaggcaccggcacuca

SEQ ID NO: 3819 - RNA, 22 nt, Homo sapiens
accuaauauaucaaacauauca

SEQ ID NO: 3820 - RNA, 21 nt, Homo sapiens
aacccaauaucaaacauauca

SEQ ID NO: 3821 - RNA, 21 nt, Homo sapiens
aggcggcaggcacaggacugg

SEQ ID NO: 3822 - RNA, 20 nt, Homo sapiens
ggagaccacaaugccuggug

SEQ ID NO: 3823 - RNA, 23 nt, Homo sapiens
cccaacagacauggcgguacuca

SEQ ID NO: 3824 - RNA, 22 nt, Homo sapiens
uucacacugcaugcucugggua

SEQ ID NO: 3825 - RNA, 22 nt, Homo sapiens
uggcagcagcggagggggcaga

SEQ ID NO: 3826 - RNA, 22 nt, Homo sapiens
ggggacgaaauccaagcgcagc

SEQ ID NO: 3827 - RNA, 22 nt, Homo sapiens
ccucccagugcgggaccccucc

SEQ ID NO: 3828 - RNA, 22 nt, Homo sapiens
cagaagugggccgggcacaggg

SEQ ID NO: 3829 - RNA, 20 nt, Homo sapiens
cccgccgcgucgcccugggg

SEQ ID NO: 3830 - RNA, 22 nt, Homo sapiens
ggcccgggcagcaaggcaaggu

SEQ ID NO: 3831 - RNA, 23 nt, Homo sapiens
cagcugcuuuugggauuccguug

SEQ ID NO: 3832 - RNA, 22 nt, Homo sapiens
cugugaccuauggaauuggcag

SEQ ID NO: 3833 - RNA, 21 nt, Homo sapiens
ggcugucaauucauaggucag

SEQ ID NO: 3834 - RNA, 22 nt, Homo sapiens
acugggacuuuguaggccaguu

SEQ ID NO: 3835 - RNA, 22 nt, Homo sapiens
ucaucucgcccgcaaagaccca

SEQ ID NO: 3836 - RNA, 22 nt, Homo sapiens
agcgggacuuugagggccaguu

SEQ ID NO: 3837 - RNA, 22 nt, Homo sapiens
ucaucucgcccucaaaaccccg

SEQ ID NO: 3838 - RNA, 22 nt, Homo sapiens
cagauaacagcagccccacugg

SEQ ID NO: 3839 - RNA, 22 nt, Homo sapiens
uccacauggaguugcuguuaca

SEQ ID NO: 3840 - RNA, 22 nt, Homo sapiens
ggagcagcacagccaauauugg

SEQ ID NO: 3841 - RNA, 21 nt, Homo sapiens
gccaauauuucugugcugcua

SEQ ID NO: 3842 - RNA, 22 nt, Homo sapiens
cucaggcaguuucuuguugccg

SEQ ID NO: 3843 - RNA, 22 nt, Homo sapiens
cccaacaacaugaaacuaccua

SEQ ID NO: 3844 - RNA, 22 nt, Homo sapiens
gaaggcagugucgugcugucga

SEQ ID NO: 3845 - RNA, 22 nt, Homo sapiens
cccaacaacaggaaacuaccua

SEQ ID NO: 3846 - RNA, 22 nt, Homo sapiens
ugagccacugugccuggccuga

SEQ ID NO: 3847 - RNA, 19 nt, Homo sapiens
uaugcuaccuuugcacggu

SEQ ID NO: 3848 - RNA, 22 nt, Homo sapiens
gcuggguggagaagguggugaa

SEQ ID NO: 3849 - RNA, 23 nt, Homo sapiens
ccucccacugcccucucuacccg

SEQ ID NO: 3850 - RNA, 20 nt, Homo sapiens
acagcaaggagggcaggagg

SEQ ID NO: 3851 - RNA, 22 nt, Homo sapiens
gaaccuaucuccccucuggacc

SEQ ID NO: 3852 - RNA, 22 nt, Homo sapiens
uaaccaaugugcagacuacugu

SEQ ID NO: 3853 - RNA, 23 nt, Homo sapiens
gaacagguagucugaacacuggg

SEQ ID NO: 3854 - RNA, 22 nt, Homo sapiens
uaaccaaugugcagacuacugu

SEQ ID NO: 3855 - RNA, 23 nt, Homo sapiens
gaacagauagucuaaacacuggg

SEQ ID NO: 3856 - RNA, 23 nt, Homo sapiens
ucaguuuugcauagauuugcaca

SEQ ID NO: 3857 - RNA, 22 nt, Homo sapiens
uguagugcaacuaugcaaaacu

SEQ ID NO: 3858 - RNA, 23 nt, Homo sapiens
gcuggaugcaaaccugcaaaacu

SEQ ID NO: 3859 - RNA, 22 nt, Homo sapiens
ugaaaugcaaaccugcaaaacu

SEQ ID NO: 3860 - RNA, 23 nt, Homo sapiens
ucaguuuugcauggauuugcaca

SEQ ID NO: 3861 - RNA, 22 nt, Homo sapiens
acaucguuaccagacaguguua

SEQ ID NO: 3862 - RNA, 22 nt, Homo sapiens
uccagcacuguccgguaagaug

SEQ ID NO: 3863 - RNA, 22 nt, Homo sapiens
ucaucauuaccaggcaguauua

SEQ ID NO: 3864 - RNA, 22 nt, Homo sapiens
uccaaugcugcccaguaagaug

SEQ ID NO: 3865 - RNA, 23 nt, Homo sapiens
uccaucauuacccggcaguauua

SEQ ID NO: 3866 - RNA, 22 nt, Homo sapiens
ccaaacacugcuggguaagacg

SEQ ID NO: 3867 - RNA, 20 nt, Homo sapiens
uucccaugcccuauaccucu

SEQ ID NO: 3868 - RNA, 22 nt, Homo sapiens
caaagaaguauaugcauaggaa

SEQ ID NO: 3869 - RNA, 22 nt, Homo sapiens
cuagugguccuaaacauuucac

SEQ ID NO: 3870 - RNA, 23 nt, Homo sapiens
uccagugguucuuaacaguucaa

SEQ ID NO: 3871 - RNA, 22 nt, Homo sapiens
ugugaaauguuuaggaccacua

SEQ ID NO: 3872 - RNA, 21 nt, Homo sapiens
acgucccuuugccuucccagc

SEQ ID NO: 3873 - RNA, 22 nt, Homo sapiens
aggcauaggaugacaaagggaa

SEQ ID NO: 3874 - RNA, 20 nt, Homo sapiens
acauuacuguuaucaaaaca

SEQ ID NO: 3875 - RNA, 23 nt, Homo sapiens
guaaauagagguuuaauuaacac

SEQ ID NO: 3876 - RNA, 21 nt, Homo sapiens
gaacuucacuccacugaaauc

SEQ ID NO: 3877 - RNA, 23 nt, Homo sapiens
aauaaauuaaauuuauauuacag

SEQ ID NO: 3878 - RNA, 22 nt, Homo sapiens
cagacuccgguggaaugaagga

SEQ ID NO: 3879 - RNA, 22 nt, Homo sapiens
ccacacacuuccuuacauucca

SEQ ID NO: 3880 - RNA, 22 nt, Homo sapiens
acaagcuuuuugcucgucuuau

SEQ ID NO: 3881 - RNA, 22 nt, Homo sapiens
acaaaccuuuuguucgucuuau

SEQ ID NO: 3882 - RNA, 22 nt, Homo sapiens
cuuuaagugcucauaaugcagu

SEQ ID NO: 3883 - RNA, 23 nt, Homo sapiens
cuaccugcacuauaagcacuuua

SEQ ID NO: 3884 - RNA, 22 nt, Homo sapiens
cuggaagugcccauacuacagu

SEQ ID NO: 3885 - RNA, 23 nt, Homo sapiens
cuaccugcacuaugagcacuuug

SEQ ID NO: 3886 - RNA, 22 nt, Homo sapiens
ucagccgcugucacacgcacag

SEQ ID NO: 3887 - RNA, 22 nt, Homo sapiens
cacucagcggccguuuccccaa

SEQ ID NO: 3888 - RNA, 21 nt, Homo sapiens
gugacagagccaagcacaaau

SEQ ID NO: 3889 - RNA, 21 nt, Homo sapiens
gcaccccuuugcugucccugc

SEQ ID NO: 3890 - RNA, 21 nt, Homo sapiens
aagucccuugcuugaggcucg

SEQ ID NO: 3891 - RNA, 22 nt, Homo sapiens
gaccgcuucaaggaagggacua

SEQ ID NO: 3892 - RNA, 22 nt, Homo sapiens
cuagccuccaugaauucugaug

SEQ ID NO: 3893 - RNA, 22 nt, Homo sapiens
uccaucaggagucauggaagcu

SEQ ID NO: 3894 - RNA, 22 nt, Homo sapiens
aggcgaaggaugacaaagggaa

SEQ ID NO: 3895 - RNA, 21 nt, Homo sapiens
gggaguucuuggcaugggagg

SEQ ID NO: 3896 - RNA, 21 nt, Homo sapiens
agaccuccuaugcuaagaacc

SEQ ID NO: 3897 - RNA, 21 nt, Homo sapiens
cuguccuuggcaaagagaaca

SEQ ID NO: 3898 - RNA, 21 nt, Homo sapiens
ggccgugacuggagacuguua

SEQ ID NO: 3899 - RNA, 23 nt, Homo sapiens
aguaagcagucuagagccaaggu

SEQ ID NO: 3900 - RNA, 21 nt, Homo sapiens
acagcccaucgacugguguug

SEQ ID NO: 3901 - RNA, 22 nt, Homo sapiens
acugccugucugugccugcugu

SEQ ID NO: 3902 - RNA, 22 nt, Homo sapiens
gcacagcaaguguagacaggca

SEQ ID NO: 3903 - RNA, 21 nt, Homo sapiens
gucugucaauucauaggucau

SEQ ID NO: 3904 - RNA, 22 nt, Homo sapiens
ucaacaucagucugauaagcua

SEQ ID NO: 3905 - RNA, 22 nt, Homo sapiens
auaaucccagagaccacuguga

SEQ ID NO: 3906 - RNA, 22 nt, Homo sapiens
ucacaguugccagcugagauua

SEQ ID NO: 3907 - RNA, 22 nt, Homo sapiens
ucacauuugccugcagagauuu

SEQ ID NO: 3908 - RNA, 23 nt, Homo sapiens
uccaaucaguuccugaugcagua

SEQ ID NO: 3909 - RNA, 22 nt, Homo sapiens
ccauggugcuugacggaaccau

SEQ ID NO: 3910 - RNA, 22 nt, Homo sapiens
cgcggugcuugacagaaccaug

SEQ ID NO: 3911 - RNA, 21 nt, Homo sapiens
acaugguuagaucaagcacaa

SEQ ID NO: 3912 - RNA, 22 nt, Homo sapiens
cgggacguccagacucaacucu

SEQ ID NO: 3913 - RNA, 22 nt, Homo sapiens
acagauguccagccacaauucu

SEQ ID NO: 3914 - RNA, 21 nt, Homo sapiens
agaauugcguuuggacaauca

SEQ ID NO: 3915 - RNA, 23 nt, Homo sapiens
gaaacccagcagacaauguagcu

SEQ ID NO: 3916 - RNA, 22 nt, Homo sapiens
aaaucuacauuguaugccaggu

SEQ ID NO: 3917 - RNA, 21 nt, Homo sapiens
acccaguagccagauguagcu

SEQ ID NO: 3918 - RNA, 22 nt, Homo sapiens
aggaucuacacuggcuacugag

SEQ ID NO: 3919 - RNA, 22 nt, Homo sapiens
ugggguauuugacaaacugaca

SEQ ID NO: 3920 - RNA, 22 nt, Homo sapiens
aacucagcuugucaaauacacg

SEQ ID NO: 3921 - RNA, 22 nt, Homo sapiens
acaguucuucaacuggcagcuu

SEQ ID NO: 3922 - RNA, 23 nt, Homo sapiens
uguagucacuagggcaccauuuu

SEQ ID NO: 3923 - RNA, 21 nt, Homo sapiens
aacggaaccacuagugacuug

SEQ ID NO: 3924 - RNA, 22 nt, Homo sapiens
uaaagcuugccacugaagaacu

SEQ ID NO: 3925 - RNA, 22 nt, Homo sapiens
ccucgccucugacacuugcaga

SEQ ID NO: 3926 - RNA, 21 nt, Homo sapiens
gagccaggcagggcgcuguca

SEQ ID NO: 3927 - RNA, 24 nt, Homo sapiens
gacuggcagcgcucagcccgcgcu

SEQ ID NO: 3928 - RNA, 22 nt, Homo sapiens
ccaggcaacacacacugcucuc

SEQ ID NO: 3929 - RNA, 22 nt, Homo sapiens
aucuccaaacagcaaggacaau

SEQ ID NO: 3930 - RNA, 21 nt, Homo sapiens
uuguccauuguaucuggggau

SEQ ID NO: 3931 - RNA, 20 nt, Homo sapiens
caccucucacccccauccua

SEQ ID NO: 3932 - RNA, 21 nt, Homo sapiens
ggaaaucccuggcaaugugau

SEQ ID NO: 3933 - RNA, 22 nt, Homo sapiens
aaaucccauccccaggaacccc

SEQ ID NO: 3934 - RNA, 21 nt, Homo sapiens
gguaaucccuggcaaugugau

SEQ ID NO: 3935 - RNA, 22 nt, Homo sapiens
aaaucagcaugccaggaaccca

SEQ ID NO: 3936 - RNA, 22 nt, Homo sapiens
ggguaaucacuggcaaugugau

SEQ ID NO: 3937 - RNA, 22 nt, Homo sapiens
acugauaucagcucaguaggca

SEQ ID NO: 3938 - RNA, 22 nt, Homo sapiens
cuguguuucagcucaguaggca

SEQ ID NO: 3939 - RNA, 22 nt, Homo sapiens
cuguuccugcugaacugagcca

SEQ ID NO: 3940 - RNA, 22 nt, Homo sapiens
ccugagccucucugccucugcu

SEQ ID NO: 3941 - RNA, 23 nt, Homo sapiens
gagccaaggcuaacagagccuca

SEQ ID NO: 3942 - RNA, 22 nt, Homo sapiens
ucagaccgagacaagugcaaug

SEQ ID NO: 3943 - RNA, 21 nt, Homo sapiens
caauugcccaagucuccgccu

SEQ ID NO: 3944 - RNA, 22 nt, Homo sapiens
gugcuuuaccaacuccaugaua

SEQ ID NO: 3945 - RNA, 22 nt, Homo sapiens
agucuccuggaggugguaaaac

SEQ ID NO: 3946 - RNA, 22 nt, Homo sapiens
ggaagacagcgcugaagaggcg

SEQ ID NO: 3947 - RNA, 23 nt, Homo sapiens
gacgucugaacagucacugccug

SEQ ID NO: 3948 - RNA, 22 nt, Homo sapiens
cgugcaaguaaccaagaauagg

SEQ ID NO: 3949 - RNA, 22 nt, Homo sapiens
gaaacaaguaaucaagaauagg

SEQ ID NO: 3950 - RNA, 22 nt, Homo sapiens
agccuauccuggauuacuugaa

SEQ ID NO: 3951 - RNA, 22 nt, Homo sapiens
gagccaaguaauggagaacagg

SEQ ID NO: 3952 - RNA, 21 nt, Homo sapiens
accuauccugaauuacuugaa

SEQ ID NO: 3953 - RNA, 21 nt, Homo sapiens
gcggaacuuagccacugugaa

SEQ ID NO: 3954 - RNA, 22 nt, Homo sapiens
ugcucacaagcagcuaagcccu

SEQ ID NO: 3955 - RNA, 21 nt, Homo sapiens
gcagaacuuagccacugugaa

SEQ ID NO: 3956 - RNA, 22 nt, Homo sapiens
guucaccaaucagcuaagcucu

SEQ ID NO: 3957 - RNA, 22 nt, Homo sapiens
uccaggagcucacaaucuagug

SEQ ID NO: 3958 - RNA, 22 nt, Homo sapiens
cucaauagacugugagcuccuu

SEQ ID NO: 3959 - RNA, 19 nt, Homo sapiens
ccgcccaccgccaggcccc

SEQ ID NO: 3960 - RNA, 21 nt, Homo sapiens
ccaagagauguuggcccuaac

SEQ ID NO: 3961 - RNA, 22 nt, Homo sapiens
ggagagccuccacccaacccuc

SEQ ID NO: 3962 - RNA, 23 nt, Homo sapiens
acugauuguccaaacgcaauucu

SEQ ID NO: 3963 - RNA, 22 nt, Homo sapiens
cgagaauuguggcuggacaucu

SEQ ID NO: 3964 - RNA, 21 nt, Homo sapiens
acaggauugagggggggcccu

SEQ ID NO: 3965 - RNA, 21 nt, Homo sapiens
caugcacaugcacacauacau

SEQ ID NO: 3966 - RNA, 24 nt, Homo sapiens
ugggagaaccucccugcuucugcu

SEQ ID NO: 3967 - RNA, 22 nt, Homo sapiens
aagcgguuuaccaucccacaua

SEQ ID NO: 3968 - RNA, 22 nt, Homo sapiens
auguaugugggacgguaaacca

SEQ ID NO: 3969 - RNA, 22 nt, Homo sapiens
uaaccgauuucagauggugcua

SEQ ID NO: 3970 - RNA, 22 nt, Homo sapiens
cugaacaccaaaagaaaucagu

SEQ ID NO: 3971 - RNA, 24 nt, Homo sapiens
ucuaaaccaccauaugaaaccagc

SEQ ID NO: 3972 - RNA, 22 nt, Homo sapiens
cuaagccaccaugugaaaccag

SEQ ID NO: 3973 - RNA, 23 nt, Homo sapiens
aacacugauuucaaauggugcua

SEQ ID NO: 3974 - RNA, 22 nt, Homo sapiens
uaaccgauuucaaauggugcua

SEQ ID NO: 3975 - RNA, 22 nt, Homo sapiens
gaacaccaggagaaaucgguca

SEQ ID NO: 3976 - RNA, 22 nt, Homo sapiens
agagagagucugcccuuguaua

SEQ ID NO: 3977 - RNA, 23 nt, Homo sapiens
gcuuugacaauacuauugcacug

SEQ ID NO: 3978 - RNA, 22 nt, Homo sapiens
aguagugcaauaaagucagagc

SEQ ID NO: 3979 - RNA, 23 nt, Homo sapiens
gcuuugacaauaucauugcacug

SEQ ID NO: 3980 - RNA, 23 nt, Homo sapiens
ucaccaaaacauggaagcacuua

SEQ ID NO: 3981 - RNA, 23 nt, Homo sapiens
agcaaguacauccacguuuaagu

SEQ ID NO: 3982 - RNA, 23 nt, Homo sapiens
cuacuaaaacauggaagcacuua

SEQ ID NO: 3983 - RNA, 22 nt, Homo sapiens
gaaagcacuuccauguuaaagu

SEQ ID NO: 3984 - RNA, 23 nt, Homo sapiens
ccacugaaacauggaagcacuua

SEQ ID NO: 3985 - RNA, 22 nt, Homo sapiens
cagcagguacccccauguuaaa

SEQ ID NO: 3986 - RNA, 23 nt, Homo sapiens
acacucaaacauggaagcacuua

SEQ ID NO: 3987 - RNA, 22 nt, Homo sapiens
gcaagugccuccauguuaaagu

SEQ ID NO: 3988 - RNA, 17 nt, Homo sapiens
aagcauggaagcacuua

SEQ ID NO: 3989 - RNA, 17 nt, Homo sapiens
aaacauggaagcaauua

SEQ ID NO: 3990 - RNA, 23 nt, Homo sapiens
uguaagguguugcaguguggcaa

SEQ ID NO: 3991 - RNA, 21 nt, Homo sapiens
uugcacaccacaacagccaga

SEQ ID NO: 3992 - RNA, 23 nt, Homo sapiens
cuccaacaauauccuggugcuga

SEQ ID NO: 3993 - RNA, 23 nt, Homo sapiens
uccagcaucagugauuuuguuga

SEQ ID NO: 3994 - RNA, 22 nt, Homo sapiens
cggugccuacugagcugauauc

SEQ ID NO: 3995 - RNA, 21 nt, Homo sapiens
cuggcucaguucagcaggaac

SEQ ID NO: 3996 - RNA, 22 nt, Homo sapiens
gcugcaaacauccgacugaaag

SEQ ID NO: 3997 - RNA, 22 nt, Homo sapiens
cuuccagucgaggauguuuaca

SEQ ID NO: 3998 - RNA, 22 nt, Homo sapiens
gaaguaaacauccaccucccag

SEQ ID NO: 3999 - RNA, 22 nt, Homo sapiens
agcugaguguaggauguuuaca

SEQ ID NO: 4000 - RNA, 22 nt, Homo sapiens
ggaguaaacaacccucucccag

SEQ ID NO: 4001 - RNA, 22 nt, Homo sapiens
agaguaaacagccuucucccag

SEQ ID NO: 4002 - RNA, 23 nt, Homo sapiens
gcugagaguguaggauguuuaca

SEQ ID NO: 4003 - RNA, 22 nt, Homo sapiens
gcagcaaacaucugacugaaag

SEQ ID NO: 4004 - RNA, 22 nt, Homo sapiens
cuuccagucggggauguuuaca

SEQ ID NO: 4005 - RNA, 22 nt, Homo sapiens
gcuguaaacauccgacugaaag

SEQ ID NO: 4006 - RNA, 22 nt, Homo sapiens
cuuccagucaaggauguuuaca

SEQ ID NO: 4007 - RNA, 20 nt, Homo sapiens
accaacuaguaaacccauau

SEQ ID NO: 4008 - RNA, 22 nt, Homo sapiens
agucccuacuauguuccaggca

SEQ ID NO: 4009 - RNA, 21 nt, Homo sapiens
cuggcacuauaugaguccuau

SEQ ID NO: 4010 - RNA, 20 nt, Homo sapiens
auaugacucguauagugucu

SEQ ID NO: 4011 - RNA, 23 nt, Homo sapiens
agaauuuucauaaugcagucaca

SEQ ID NO: 4012 - RNA, 20 nt, Homo sapiens
gccaucaaaguuaaaagcca

SEQ ID NO: 4013 - RNA, 21 nt, Homo sapiens
ugccugucuacacuugcugug

SEQ ID NO: 4014 - RNA, 21 nt, Homo sapiens
uguacagcaggcacagacagg

SEQ ID NO: 4015 - RNA, 22 nt, Homo sapiens
uguccuuugccuacucuauuua

SEQ ID NO: 4016 - RNA, 22 nt, Homo sapiens
cuuaaauagaauaggcaaagga

SEQ ID NO: 4017 - RNA, 22 nt, Homo sapiens
aagaccguccucuugucccaac

SEQ ID NO: 4018 - RNA, 17 nt, Homo sapiens
gauuaaacaauucucug

SEQ ID NO: 4019 - RNA, 22 nt, Homo sapiens
acuucacgggagugaggaaagu

SEQ ID NO: 4020 - RNA, 21 nt, Homo sapiens
gacuuugccuucgcccgcgaa

SEQ ID NO: 4021 - RNA, 20 nt, Homo sapiens
ucucuccacagcuuccucua

SEQ ID NO: 4022 - RNA, 22 nt, Homo sapiens
ucugugugacggaugccagaug

SEQ ID NO: 4023 - RNA, 22 nt, Homo sapiens
ugcuucuggcaucugucccuca

SEQ ID NO: 4024 - RNA, 22 nt, Homo sapiens
ccagcaggccugcagaagggga

SEQ ID NO: 4025 - RNA, 23 nt, Homo sapiens
cuucccauuccacaagcccugau

SEQ ID NO: 4026 - RNA, 23 nt, Homo sapiens
augagaguuuuuuacuugccaga

SEQ ID NO: 4027 - RNA, 22 nt, Homo sapiens
gcagcaguguagagauuaguuu

SEQ ID NO: 4028 - RNA, 22 nt, Homo sapiens
aaaccaaucucuacacuacugc

SEQ ID NO: 4029 - RNA, 21 nt, Homo sapiens
uuacccagucuccggugcagc

SEQ ID NO: 4030 - RNA, 21 nt, Homo sapiens
ggcugcaccggagacugggua

SEQ ID NO: 4031 - RNA, 23 nt, Homo sapiens
aaggcccuuccaccaguccucga

SEQ ID NO: 4032 - RNA, 24 nt, Homo sapiens
uccucugagcuccuucucuaccca

SEQ ID NO: 4033 - RNA, 22 nt, Homo sapiens
auuggguuuuaagaguucuuua

SEQ ID NO: 4034 - RNA, 23 nt, Homo sapiens
aauauguagucuuuuauccauca

SEQ ID NO: 4035 - RNA, 22 nt, Homo sapiens
cacugcagucucagccuaggca

SEQ ID NO: 4036 - RNA, 22 nt, Homo sapiens
caccacugcacucgcuccagcc

SEQ ID NO: 4037 - RNA, 22 nt, Homo sapiens
acuaacugaauagguugggcca

SEQ ID NO: 4038 - RNA, 23 nt, Homo sapiens
aaugacccuaccuauucagucag

SEQ ID NO: 4039 - RNA, 24 nt, Homo sapiens
accccauugcucccaggcuacaga

SEQ ID NO: 4040 - RNA, 24 nt, Homo sapiens
acucccucuaccucacuguccaca

SEQ ID NO: 4041 - RNA, 23 nt, Homo sapiens
aacaggcaucuguugagcuccua

SEQ ID NO: 4042 - RNA, 22 nt, Homo sapiens
auggcaauauguuggcauagca

SEQ ID NO: 4043 - RNA, 22 nt, Homo sapiens
acuaccugaauucccaaaagcu

SEQ ID NO: 4044 - RNA, 21 nt, Homo sapiens
aaagcuuuugguaauucaggu

SEQ ID NO: 4045 - RNA, 19 nt, Homo sapiens
uccuccuccacccgcccuc

SEQ ID NO: 4046 - RNA, 22 nt, Homo sapiens
ucugaagguucagaaaggccuu

SEQ ID NO: 4047 - RNA, 25 nt, Homo sapiens
cgaaagaagcgcuuuacaauguuau

SEQ ID NO: 4048 - RNA, 22 nt, Homo sapiens
uaaagagaccgaacagguauau

SEQ ID NO: 4049 - RNA, 22 nt, Homo sapiens
cuauauaucucuuugguccccu

SEQ ID NO: 4050 - RNA, 24 nt, Homo sapiens
caauuccaaacacucaaaauaucu

SEQ ID NO: 4051 - RNA, 22 nt, Homo sapiens
ugaguuuugaguguuuggaguu

SEQ ID NO: 4052 - RNA, 22 nt, Homo sapiens
ccauucuuucuauccuagcaug

SEQ ID NO: 4053 - RNA, 24 nt, Homo sapiens
ucacacccuccucacugcccaacc

SEQ ID NO: 4054 - RNA, 22 nt, Homo sapiens
aagcacacaccaguuuuuucca

SEQ ID NO: 4055 - RNA, 23 nt, Homo sapiens
auacacacacauauccauacaaa

SEQ ID NO: 4056 - RNA, 22 nt, Homo sapiens
ccaaccucgaggaucuccccag

SEQ ID NO: 4057 - RNA, 22 nt, Homo sapiens
gcugaggagaucgucgagguug

SEQ ID NO: 4058 - RNA, 21 nt, Homo sapiens
ccaaccucgacgaucuccuca

SEQ ID NO: 4059 - RNA, 22 nt, Homo sapiens
gcuggggagauccucgagguug

SEQ ID NO: 4060 - RNA, 21 nt, Homo sapiens
accugaucccauugccccacc

SEQ ID NO: 4061 - RNA, 22 nt, Homo sapiens
uuauugccccuauucuaacaca

SEQ ID NO: 4062 - RNA, 22 nt, Homo sapiens
cuuguguuagaacagaggcaau

SEQ ID NO: 4063 - RNA, 23 nt, Homo sapiens
aaaugucccuacucgcuuucccc

SEQ ID NO: 4064 - RNA, 22 nt, Homo sapiens
ucugcucccaacuccccuucug

SEQ ID NO: 4065 - RNA, 21 nt, Homo sapiens
aguucccacugcagagccugg

SEQ ID NO: 4066 - RNA, 18 nt, Homo sapiens
ucccacugcagagccugg

SEQ ID NO: 4067 - RNA, 21 nt, Homo sapiens
agaaagaucuggaagugggag

SEQ ID NO: 4068 - RNA, 22 nt, Homo sapiens
ugucucccacuuccagaucuuu

SEQ ID NO: 4069 - RNA, 22 nt, Homo sapiens
agcuucagcuagacuagggcag

SEQ ID NO: 4070 - RNA, 22 nt, Homo sapiens
agacugcacuagccuggcugaa

SEQ ID NO: 4071 - RNA, 22 nt, Homo sapiens
guccugcagagaggaagcccuu

SEQ ID NO: 4072 - RNA, 21 nt, Homo sapiens
gaagggcuuccucucugcagg

SEQ ID NO: 4073 - RNA, 22 nt, Homo sapiens
guggccgacacuuguaauccua

SEQ ID NO: 4074 - RNA, 21 nt, Homo sapiens
agcuaugccagcaucuugccu

SEQ ID NO: 4075 - RNA, 22 nt, Homo sapiens
ugggcuuucuagucucagcucu

SEQ ID NO: 4076 - RNA, 22 nt, Homo sapiens
ggagagcugagacuagaaagcc

SEQ ID NO: 4077 - RNA, 23 nt, Homo sapiens
aucugggccucuguucuuaucag

SEQ ID NO: 4078 - RNA, 21 nt, Homo sapiens
uggggaguggagggguaggga

SEQ ID NO: 4079 - RNA, 23 nt, Homo sapiens
cuccccacccuucuacucccuaa

SEQ ID NO: 4080 - RNA, 22 nt, Homo sapiens
gucuuacugcccucauuuuaua

SEQ ID NO: 4081 - RNA, 22 nt, Homo sapiens
cgccauuucccuuaaagucaca

SEQ ID NO: 4082 - RNA, 22 nt, Homo sapiens
ugaggucacauugcauccaccu

SEQ ID NO: 4083 - RNA, 23 nt, Homo sapiens
uaggccaguaggcauugucugcg

SEQ ID NO: 4084 - RNA, 22 nt, Homo sapiens
acaccaguauuucugaaauccu

SEQ ID NO: 4085 - RNA, 17 nt, Homo sapiens
gucugacuguagaacuc

SEQ ID NO: 4086 - RNA, 22 nt, Homo sapiens
cuaugugccaagcacaguccua

SEQ ID NO: 4087 - RNA, 22 nt, Homo sapiens
acugucugucucagaaccccag

SEQ ID NO: 4088 - RNA, 24 nt, Homo sapiens
gauauauacagauuccauacaucu

SEQ ID NO: 4089 - RNA, 22 nt, Homo sapiens
uggccugccuauuuccuccuuu

SEQ ID NO: 4090 - RNA, 22 nt, Homo sapiens
aaaggagaaaacaggcagggca

SEQ ID NO: 4091 - RNA, 23 nt, Homo sapiens
ggcucugcaucucuaacucacua

SEQ ID NO: 4092 - RNA, 22 nt, Homo sapiens
acgucacugcguucucuccccg

SEQ ID NO: 4093 - RNA, 19 nt, Homo sapiens
ccgguagucccaggccagu

SEQ ID NO: 4094 - RNA, 21 nt, Homo sapiens
acguguccccagugccgugca

SEQ ID NO: 4095 - RNA, 23 nt, Homo sapiens
agcgccuggcacguguguacaca

SEQ ID NO: 4096 - RNA, 17 nt, Homo sapiens
cgauccggccgcgcccc

SEQ ID NO: 4097 - RNA, 22 nt, Homo sapiens
acguuuaaauuucaccccuucu

SEQ ID NO: 4098 - RNA, 19 nt, Homo sapiens
cuccggaagcuccgcccca

SEQ ID NO: 4099 - RNA, 22 nt, Homo sapiens
ggccuccggaagcuccgcccca

SEQ ID NO: 4100 - RNA, 25 nt, Homo sapiens
cgacguggggcggagcgucuggaag

SEQ ID NO: 4101 - RNA, 19 nt, Homo sapiens
ccggcgccgagggcccgau

SEQ ID NO: 4102 - RNA, 17 nt, Homo sapiens
gacuacacuacagaagc

SEQ ID NO: 4103 - RNA, 22 nt, Homo sapiens
uccgagcgacuccgagagaggc

SEQ ID NO: 4104 - RNA, 23 nt, Homo sapiens
ugaggggcagagagcgagacuuu

SEQ ID NO: 4105 - RNA, 24 nt, Homo sapiens
aaaagcucggucugaggccccuca

SEQ ID NO: 4106 - RNA, 23 nt, Homo sapiens
ccgcagaccgaccgccuucuucu

SEQ ID NO: 4107 - RNA, 21 nt, Homo sapiens
caaagccaucucuccgcguga

SEQ ID NO: 4108 - RNA, 22 nt, Homo sapiens
aagccacguagacagacgccug

SEQ ID NO: 4109 - RNA, 20 nt, Homo sapiens
ccgcgcagccccauggccaa

SEQ ID NO: 4110 - RNA, 23 nt, Homo sapiens
ccuucagccacacgcugcccagg

SEQ ID NO: 4111 - RNA, 23 nt, Homo sapiens
ccccguauccgcacaaagccucu

SEQ ID NO: 4112 - RNA, 21 nt, Homo sapiens
cuaccccaucagacccaaggg

SEQ ID NO: 4113 - RNA, 25 nt, Homo sapiens
uccuacccagggcacagauggggca

SEQ ID NO: 4114 - RNA, 23 nt, Homo sapiens
ucucuggccgucuaccuuccaca

SEQ ID NO: 4115 - RNA, 20 nt, Homo sapiens
uggggacguagcuggccaga

SEQ ID NO: 4116 - RNA, 23 nt, Homo sapiens
cugucuggccagcuacgucccca

SEQ ID NO: 4117 - RNA, 22 nt, Homo sapiens
uggaagguagacggccagagag

SEQ ID NO: 4118 - RNA, 23 nt, Homo sapiens
uuccacugcuacaaccucccaga

SEQ ID NO: 4119 - RNA, 22 nt, Homo sapiens
acuccucagauccuacgcagga

SEQ ID NO: 4120 - RNA, 22 nt, Homo sapiens
acugccagugagcagcagagcu

SEQ ID NO: 4121 - RNA, 21 nt, Homo sapiens
cagcccuccugguggcuggcc

SEQ ID NO: 4122 - RNA, 17 nt, Homo sapiens
aacccgggcccggcgcg

SEQ ID NO: 4123 - RNA, 18 nt, Homo sapiens
gaggccccugccgccccg

SEQ ID NO: 4124 - RNA, 23 nt, Homo sapiens
cgccuuuccgagccugcgccucc

SEQ ID NO: 4125 - RNA, 22 nt, Homo sapiens
ucuccauuccccaggacuccac

SEQ ID NO: 4126 - RNA, 23 nt, Homo sapiens
aacuuucuccuaaggcagucccu

SEQ ID NO: 4127 - RNA, 22 nt, Homo sapiens
cagaccugaguagcgcaaggug

SEQ ID NO: 4128 - RNA, 22 nt, Homo sapiens
accuugugcgccuucucagauu

SEQ ID NO: 4129 - RNA, 17 nt, Homo sapiens
auuuuucuucauauccc

SEQ ID NO: 4130 - RNA, 22 nt, Homo sapiens
auuaaagcucuucucccuucca

SEQ ID NO: 4131 - RNA, 22 nt, Homo sapiens
ucgcccucucaacccagcuuuu

SEQ ID NO: 4132 - RNA, 22 nt, Homo sapiens
uugcccucucaacccagcuuuu

SEQ ID NO: 4133 - RNA, 20 nt, Homo sapiens
acccucucaacccagcuuuu

SEQ ID NO: 4134 - RNA, 19 nt, Homo sapiens
uccucucaacccagcuuuu

SEQ ID NO: 4135 - RNA, 18 nt, Homo sapiens
ccuucucaacccagcuuu

SEQ ID NO: 4136 - RNA, 21 nt, Homo sapiens
agaggucgaccguguaaugug

SEQ ID NO: 4137 - RNA, 22 nt, Homo sapiens
gcgaacgcgccacggaccaccu

SEQ ID NO: 4138 - RNA, 22 nt, Homo sapiens
aagaggucgaccguguauuggg

SEQ ID NO: 4139 - RNA, 23 nt, Homo sapiens
ugcgaacucaccacggacaaccu

SEQ ID NO: 4140 - RNA, 22 nt, Homo sapiens
aaauaucacacacacuaaauug

SEQ ID NO: 4141 - RNA, 20 nt, Homo sapiens
ccagcagcaccuggggcagu

SEQ ID NO: 4142 - RNA, 23 nt, Homo sapiens
acaccaaugcccuaggggaugcg

SEQ ID NO: 4143 - RNA, 23 nt, Homo sapiens
acacuuacuggacaccuacuagg

SEQ ID NO: 4144 - RNA, 22 nt, Homo sapiens
ugcaacuuaguaaugugcaaua

SEQ ID NO: 4145 - RNA, 20 nt, Homo sapiens
cuggaggaagggcccagagg

SEQ ID NO: 4146 - RNA, 22 nt, Homo sapiens
acggaagggcagagagggccag

SEQ ID NO: 4147 - RNA, 22 nt, Homo sapiens
aaagagguuaaccagguguguu

SEQ ID NO: 4148 - RNA, 23 nt, Homo sapiens
ucucugcaggccgugugcuuugc

SEQ ID NO: 4149 - RNA, 22 nt, Homo sapiens
gccuaagacacaggcccagaga

SEQ ID NO: 4150 - RNA, 21 nt, Homo sapiens
uucuaggauaggcccaggggc

SEQ ID NO: 4151 - RNA, 22 nt, Homo sapiens
ggaucccugggaccauaccuag

SEQ ID NO: 4152 - RNA, 22 nt, Homo sapiens
ggucaggagcaauaaugaaaaa

SEQ ID NO: 4153 - RNA, 23 nt, Homo sapiens
acauuuuucguuauugcucuuga

SEQ ID NO: 4154 - RNA, 22 nt, Homo sapiens
gaagaaaggcaucauauaggag

SEQ ID NO: 4155 - RNA, 21 nt, Homo sapiens
aacuccuguaugaagccguuc

SEQ ID NO: 4156 - RNA, 22 nt, Homo sapiens
caacaaaaucacugaugcugga

SEQ ID NO: 4157 - RNA, 22 nt, Homo sapiens
cacucagcaccaggauauuguu

SEQ ID NO: 4158 - RNA, 23 nt, Homo sapiens
cggcucugucgucgaggcgcuca

SEQ ID NO: 4159 - RNA, 23 nt, Homo sapiens
cgugagcuccuggaggacaggga

SEQ ID NO: 4160 - RNA, 22 nt, Homo sapiens
gugaugcacuguggaaacauug

SEQ ID NO: 4161 - RNA, 21 nt, Homo sapiens
ugcaaugcaacuacaaugcac

SEQ ID NO: 4162 - RNA, 22 nt, Homo sapiens
gggcugcacugccgaggcacug

SEQ ID NO: 4163 - RNA, 20 nt, Homo sapiens
gcaaugcaacagcaaugcac

SEQ ID NO: 4164 - RNA, 22 nt, Homo sapiens
gcuauaaaguaacugagacgga

SEQ ID NO: 4165 - RNA, 22 nt, Homo sapiens
aaucagucucauugcuuuauaa

SEQ ID NO: 4166 - RNA, 23 nt, Homo sapiens
acgggugcgauuucugugugaga

SEQ ID NO: 4167 - RNA, 21 nt, Homo sapiens
ucaaucacagauagcaccccu

SEQ ID NO: 4168 - RNA, 22 nt, Homo sapiens
cuccagaccccucguucagggc

SEQ ID NO: 4169 - RNA, 22 nt, Homo sapiens
gagcccuggacuaggagucagc

SEQ ID NO: 4170 - RNA, 23 nt, Homo sapiens
agaggcaggcaugcgggcagaca

SEQ ID NO: 4171 - RNA, 22 nt, Homo sapiens
agggcaguauacuugcugauug

SEQ ID NO: 4172 - RNA, 22 nt, Homo sapiens
acaaccagcuaagacacugcca

SEQ ID NO: 4173 - RNA, 22 nt, Homo sapiens
auggcaguggaguuagugauug

SEQ ID NO: 4174 - RNA, 23 nt, Homo sapiens
caaucagcuaaugacacugccua

SEQ ID NO: 4175 - RNA, 22 nt, Homo sapiens
ccuggccgugugguuagugauu

SEQ ID NO: 4176 - RNA, 23 nt, Homo sapiens
gcaaucagcuaacuacacugccu

SEQ ID NO: 4177 - RNA, 24 nt, Homo sapiens
uggaagacuagugauuuuguuguu

SEQ ID NO: 4178 - RNA, 22 nt, Homo sapiens
aacaacaaaucccagucuaccu

SEQ ID NO: 4179 - RNA, 22 nt, Homo sapiens
guggagugugacaaugguguuu

SEQ ID NO: 4180 - RNA, 23 nt, Homo sapiens
ucaaacgccauuaucacacuaaa

SEQ ID NO: 4181 - RNA, 23 nt, Homo sapiens
cuagaggacagguaacacggagg

SEQ ID NO: 4182 - RNA, 23 nt, Homo sapiens
ggcuuccuugcuauccauccuca

SEQ ID NO: 4183 - RNA, 21 nt, Homo sapiens
cuaaguagugaaagaaauuuu

SEQ ID NO: 4184 - RNA, 21 nt, Homo sapiens
aauuaaaauagccuucacuaa

SEQ ID NO: 4185 - RNA, 20 nt, Homo sapiens
caucagaaagcguuuacagu

SEQ ID NO: 4186 - RNA, 22 nt, Homo sapiens
acugauuugcuucaucacaugc

SEQ ID NO: 4187 - RNA, 24 nt, Homo sapiens
cagccaguauuacucaucacuuug

SEQ ID NO: 4188 - RNA, 20 nt, Homo sapiens
cggcgccuccuuuccgauuc

SEQ ID NO: 4189 - RNA, 21 nt, Homo sapiens
uaagaauuucuuucuucacaa

SEQ ID NO: 4190 - RNA, 22 nt, Homo sapiens
uccauuucucaagaugccuccu

SEQ ID NO: 4191 - RNA, 24 nt, Homo sapiens
gaaggguugggcuuuuuuuuuugu

SEQ ID NO: 4192 - RNA, 22 nt, Homo sapiens
gaacaaaaaaaaaaguacaaca

SEQ ID NO: 4193 - RNA, 23 nt, Homo sapiens
aaaucagaaucacaccuggggga

SEQ ID NO: 4194 - RNA, 23 nt, Homo sapiens
aaaacaccaagaucugaaggcua

SEQ ID NO: 4195 - RNA, 23 nt, Homo sapiens
gggcagccuucagauccaagugg

SEQ ID NO: 4196 - RNA, 21 nt, Homo sapiens
gagccgcgaggagccgagaga

SEQ ID NO: 4197 - RNA, 22 nt, Homo sapiens
guaccccuggagauucugauaa

SEQ ID NO: 4198 - RNA, 23 nt, Homo sapiens
gccugcaucaugaaaugcccucg

SEQ ID NO: 4199 - RNA, 22 nt, Homo sapiens
acauaucaugagugcacuucau

SEQ ID NO: 4200 - RNA, 23 nt, Homo sapiens
agaaaggacauagggugcugaug

SEQ ID NO: 4201 - RNA, 22 nt, Homo sapiens
cccaucuugcaacuaugucuuu

SEQ ID NO: 4202 - RNA, 22 nt, Homo sapiens
gcucuuuucauuaauguagaca

SEQ ID NO: 4203 - RNA, 22 nt, Homo sapiens
ccacagcaggcaggaugguccc

SEQ ID NO: 4204 - RNA, 22 nt, Homo sapiens
gcugcaccagccugccugcuga

SEQ ID NO: 4205 - RNA, 22 nt, Homo sapiens
cugggugcgggaugcaggguga

SEQ ID NO: 4206 - RNA, 22 nt, Homo sapiens
ggcccagcccagcccagcccac

SEQ ID NO: 4207 - RNA, 20 nt, Homo sapiens
ccugcagaccccgacccgcg

SEQ ID NO: 4208 - RNA, 22 nt, Homo sapiens
acaggcaugggaggucagguga

SEQ ID NO: 4209 - RNA, 22 nt, Homo sapiens
cucaccugagcucccgugccug

SEQ ID NO: 4210 - RNA, 21 nt, Homo sapiens
caggcacgggagcucagguga

SEQ ID NO: 4211 - RNA, 20 nt, Homo sapiens
ucaccugaccucccaugccu

SEQ ID NO: 4212 - RNA, 22 nt, Homo sapiens
ugaauccuugaauagguguguu

SEQ ID NO: 4213 - RNA, 24 nt, Homo sapiens
acucacaccuagguuccaaggauu

SEQ ID NO: 4214 - RNA, 22 nt, Homo sapiens
uacagauggauaccgugcaauu

SEQ ID NO: 4215 - RNA, 22 nt, Homo sapiens
aaauugcaucgugauccacccg

SEQ ID NO: 4216 - RNA, 22 nt, Homo sapiens
ugggcugggcucauuucauuuu

SEQ ID NO: 4217 - RNA, 21 nt, Homo sapiens
cccucggcgauccccgcggcu

SEQ ID NO: 4218 - RNA, 19 nt, Homo sapiens
cuuagacacucaggucccu

SEQ ID NO: 4219 - RNA, 19 nt, Homo sapiens
ggacucuacagacacaccu

SEQ ID NO: 4220 - RNA, 24 nt, Homo sapiens
ucauguaccagcgaccgggcuaug

SEQ ID NO: 4221 - RNA, 18 nt, Homo sapiens
uccucacaccuccagccg

SEQ ID NO: 4222 - RNA, 18 nt, Homo sapiens
cuucagucaacuucuuag

SEQ ID NO: 4223 - RNA, 19 nt, Homo sapiens
uuccucagcuuguccaguc

SEQ ID NO: 4224 - RNA, 21 nt, Homo sapiens
agcaacaccgcagcgacaagc

SEQ ID NO: 4225 - RNA, 17 nt, Homo sapiens
ccacccccgcacccgcc

SEQ ID NO: 4226 - RNA, 21 nt, Homo sapiens
aaucaccaauaaugggacaca

SEQ ID NO: 4227 - RNA, 22 nt, Homo sapiens
aucuccaugguguuuucuuaaa

SEQ ID NO: 4228 - RNA, 21 nt, Homo sapiens
ugcccucguagacaacacuca

SEQ ID NO: 4229 - RNA, 22 nt, Homo sapiens
auaaggauuuuuaggggcauua

SEQ ID NO: 4230 - RNA, 23 nt, Homo sapiens
cacaucugcccccaaaagucccu

SEQ ID NO: 4231 - RNA, 22 nt, Homo sapiens
auaaggauuuuuaggggcauua

SEQ ID NO: 4232 - RNA, 22 nt, Homo sapiens
acagcugccccugaaagucccu

SEQ ID NO: 4233 - RNA, 21 nt, Homo sapiens
ucaaaaugcucuccugucagu

SEQ ID NO: 4234 - RNA, 22 nt, Homo sapiens
cagcuguccgagucccagguca

SEQ ID NO: 4235 - RNA, 24 nt, Homo sapiens
caucagucacuacucaucauuuuc

SEQ ID NO: 4236 - RNA, 23 nt, Homo sapiens
gcgcccggccuguguggugcuca

SEQ ID NO: 4237 - RNA, 21 nt, Homo sapiens
ccgagcaccacgcagaccagc

SEQ ID NO: 4238 - RNA, 22 nt, Homo sapiens
aacucugucuuuacuccugaga

SEQ ID NO: 4239 - RNA, 22 nt, Homo sapiens
acucaugagugaagacagaguu

SEQ ID NO: 4240 - RNA, 18 nt, Homo sapiens
cgccgccccgcaccugcu

SEQ ID NO: 4241 - RNA, 21 nt, Homo sapiens
ucggcaucuacacuugcacug

SEQ ID NO: 4242 - RNA, 22 nt, Homo sapiens
aaagacccauggagaggaaggu

SEQ ID NO: 4243 - RNA, 22 nt, Homo sapiens
accuucuccucaaugggucuuu

SEQ ID NO: 4244 - RNA, 21 nt, Homo sapiens
auuuugaucaaucucuacauu

SEQ ID NO: 4245 - RNA, 23 nt, Homo sapiens
uauauuccguauacauauuccgu

SEQ ID NO: 4246 - RNA, 24 nt, Homo sapiens
uagagaaggacagcugugagcucu

SEQ ID NO: 4247 - RNA, 22 nt, Homo sapiens
ugcagacuaguccuuauuugau

SEQ ID NO: 4248 - RNA, 23 nt, Homo sapiens
aagauguuuuacaugagucucau

SEQ ID NO: 4249 - RNA, 21 nt, Homo sapiens
uauuccguauauacauuccau

SEQ ID NO: 4250 - RNA, 22 nt, Homo sapiens
ucaccauugcuaaagugcaauu

SEQ ID NO: 4251 - RNA, 22 nt, Homo sapiens
ggccaaucuuagguucuacaau

SEQ ID NO: 4252 - RNA, 22 nt, Homo sapiens
uugggggaguuccuuagagaug

SEQ ID NO: 4253 - RNA, 23 nt, Homo sapiens
gaaaucucuacagaagccccaua

SEQ ID NO: 4254 - RNA, 22 nt, Homo sapiens
agaguugcauauuagcaacagu

SEQ ID NO: 4255 - RNA, 20 nt, Homo sapiens
aaagcgugggggaaacacgg

SEQ ID NO: 4256 - RNA, 15 nt, Homo sapiens
aacccaggaucuccu

SEQ ID NO: 4257 - RNA, 22 nt, Homo sapiens
ggccguggccagagcccacgag

SEQ ID NO: 4258 - RNA, 22 nt, Homo sapiens
cacugcagggcucuggccacug

SEQ ID NO: 4259 - RNA, 22 nt, Homo sapiens
ccgguccguacaaacucugcag

SEQ ID NO: 4260 - RNA, 20 nt, Homo sapiens
cacagcagaguuuguacgga

SEQ ID NO: 4261 - RNA, 22 nt, Homo sapiens
gaugaagauuacuggggggaag

SEQ ID NO: 4262 - RNA, 23 nt, Homo sapiens
uccccuucccugccauauccuca

SEQ ID NO: 4263 - RNA, 23 nt, Homo sapiens
ccuacucccagggucaugcaaaa

SEQ ID NO: 4264 - RNA, 22 nt, Homo sapiens
ugcacaauccugugagugaguc

SEQ ID NO: 4265 - RNA, 22 nt, Homo sapiens
aguaguggaugaagcacugugu

SEQ ID NO: 4266 - RNA, 22 nt, Homo sapiens
gcacagagugcaucauccacua

SEQ ID NO: 4267 - RNA, 21 nt, Homo sapiens
cuaccuccaccuguaucauca

SEQ ID NO: 4268 - RNA, 22 nt, Homo sapiens
augauaacacagguagaaguag

SEQ ID NO: 4269 - RNA, 22 nt, Homo sapiens
ugauacuacuuccaaugucgca

SEQ ID NO: 4270 - RNA, 21 nt, Homo sapiens
aaggacguguacuaggucuaa

SEQ ID NO: 4271 - RNA, 22 nt, Homo sapiens
agucuucagguaggguaggaaa

SEQ ID NO: 4272 - RNA, 22 nt, Homo sapiens
ucauuuacuuucucuuacagau

SEQ ID NO: 4273 - RNA, 24 nt, Homo sapiens
acgucgcacgaacgccuguccggg

SEQ ID NO: 4274 - RNA, 22 nt, Homo sapiens
agaguggcaaagucuuuccaua

SEQ ID NO: 4275 - RNA, 21 nt, Homo sapiens
auauggaaagacuuugccacu

SEQ ID NO: 4276 - RNA, 22 nt, Homo sapiens
accacgauaucacaccucccag

SEQ ID NO: 4277 - RNA, 22 nt, Homo sapiens
ucccaggaaccaugauaucaca

SEQ ID NO: 4278 - RNA, 22 nt, Homo sapiens
accacaauaucacaccucccag

SEQ ID NO: 4279 - RNA, 22 nt, Homo sapiens
ucccaggaaccaugauaucaca

SEQ ID NO: 4280 - RNA, 22 nt, Homo sapiens
accacaauaucacaccucccag

SEQ ID NO: 4281 - RNA, 22 nt, Homo sapiens
cgagugugagaucacaccuccc

SEQ ID NO: 4282 - RNA, 22 nt, Homo sapiens
ucccaggaaccaugauaucaca

SEQ ID NO: 4283 - RNA, 22 nt, Homo sapiens
ucccaggaagcacgauaucaca

SEQ ID NO: 4284 - RNA, 23 nt, Homo sapiens
cuuugucuacgcuggguccaggu

SEQ ID NO: 4285 - RNA, 22 nt, Homo sapiens
gagaggaugacgcagacuuggu

SEQ ID NO: 4286 - RNA, 23 nt, Homo sapiens
guaccgagucuccaucauccacu

SEQ ID NO: 4287 - RNA, 24 nt, Homo sapiens
acuucugcagugucaguguggaac

SEQ ID NO: 4288 - RNA, 24 nt, Homo sapiens
caguauccacuccugaccagcagg

SEQ ID NO: 4289 - RNA, 21 nt, Homo sapiens
aaagaucaaccauguauuauu

SEQ ID NO: 4290 - RNA, 22 nt, Homo sapiens
gcgaauauaacacggucgaucu

SEQ ID NO: 4291 - RNA, 22 nt, Homo sapiens
accagguuccaccccagcaggc

SEQ ID NO: 4292 - RNA, 20 nt, Homo sapiens
accauccccaaacggauacc

SEQ ID NO: 4293 - RNA, 22 nt, Homo sapiens
acaggggagcacugcugccuuc

SEQ ID NO: 4294 - RNA, 23 nt, Homo sapiens
acacucaaaagauggcggcacuu

SEQ ID NO: 4295 - RNA, 20 nt, Homo sapiens
agugcccccacaguuugagu

SEQ ID NO: 4296 - RNA, 23 nt, Homo sapiens
gcacucaaacugugggggcacuu

SEQ ID NO: 4297 - RNA, 22 nt, Homo sapiens
aaagugccgccaucuuuugagu

SEQ ID NO: 4298 - RNA, 23 nt, Homo sapiens
acgcucaaaugucgcagcacuuu

SEQ ID NO: 4299 - RNA, 23 nt, Homo sapiens
acaccccaaaaucgaagcacuuc

SEQ ID NO: 4300 - RNA, 22 nt, Homo sapiens
ggaaagcgcccccauuuugagu

SEQ ID NO: 4301 - RNA, 22 nt, Homo sapiens
aauuacaauacaaucugauaag

SEQ ID NO: 4302 - RNA, 22 nt, Homo sapiens
cacuuaucagguuguauuauaa

SEQ ID NO: 4303 - RNA, 22 nt, Homo sapiens
aaugauaauacaaccugcuaag

SEQ ID NO: 4304 - RNA, 22 nt, Homo sapiens
cacuuagcagguuguauuauau

SEQ ID NO: 4305 - RNA, 22 nt, Homo sapiens
auauaauacaaccugcuaagug

SEQ ID NO: 4306 - RNA, 22 nt, Homo sapiens
agcacuuagcagguuguauuau

SEQ ID NO: 4307 - RNA, 22 nt, Homo sapiens
ucacgcgagccgaacgaacaaa

SEQ ID NO: 4308 - RNA, 21 nt, Homo sapiens
accauagaaggaaaaucuacc

SEQ ID NO: 4309 - RNA, 21 nt, Homo sapiens
acguggauuuuccucuaugau

SEQ ID NO: 4310 - RNA, 22 nt, Homo sapiens
uacucauagaaggagaaucuac

SEQ ID NO: 4311 - RNA, 22 nt, Homo sapiens
aacauggauuuuccucuaugau

SEQ ID NO: 4312 - RNA, 22 nt, Homo sapiens
aaacauagaaggaauauccacg

SEQ ID NO: 4313 - RNA, 21 nt, Homo sapiens
acguggaauuuccucuauguu

SEQ ID NO: 4314 - RNA, 21 nt, Homo sapiens
aacauagaaggaauauccacc

SEQ ID NO: 4315 - RNA, 22 nt, Homo sapiens
acaaaaguugccuuugugugau

SEQ ID NO: 4316 - RNA, 22 nt, Homo sapiens
gaauucaccaagggcaaccucu

SEQ ID NO: 4317 - RNA, 21 nt, Homo sapiens
ccuucugacuccaaguccagu

SEQ ID NO: 4318 - RNA, 22 nt, Homo sapiens
acacaggaccuggagucaggag

SEQ ID NO: 4319 - RNA, 19 nt, Homo sapiens
uucugccuccaaguccagu

SEQ ID NO: 4320 - RNA, 25 nt, Homo sapiens
ccacucuucugacuccaaguccagu

SEQ ID NO: 4321 - RNA, 20 nt, Homo sapiens
uuucugacuccaaguccagu

SEQ ID NO: 4322 - RNA, 19 nt, Homo sapiens
uccugacuccaaguccagu

SEQ ID NO: 4323 - RNA, 20 nt, Homo sapiens
cuucuggcuccaaguccagu

SEQ ID NO: 4324 - RNA, 20 nt, Homo sapiens
cuucugacuccaagcccagu

SEQ ID NO: 4325 - RNA, 21 nt, Homo sapiens
ccaucugacaccaaguccagu

SEQ ID NO: 4326 - RNA, 21 nt, Homo sapiens
ccuucugacuccuaguccagu

SEQ ID NO: 4327 - RNA, 19 nt, Homo sapiens
uucuggcuccaaauccagu

SEQ ID NO: 4328 - RNA, 22 nt, Homo sapiens
aguuaguggaccauguuacaua

SEQ ID NO: 4329 - RNA, 21 nt, Homo sapiens
ccuacguuccauagucuacca

SEQ ID NO: 4330 - RNA, 22 nt, Homo sapiens
aagauguggaccauauuacaua

SEQ ID NO: 4331 - RNA, 22 nt, Homo sapiens
gcgcauguucuauggucaacca

SEQ ID NO: 4332 - RNA, 22 nt, Homo sapiens
acagagagcuugcccuuguaua

SEQ ID NO: 4333 - RNA, 22 nt, Homo sapiens
auauacaaagggcaaccucgcu

SEQ ID NO: 4334 - RNA, 21 nt, Homo sapiens
aaguguuguccgugaaugauu

SEQ ID NO: 4335 - RNA, 22 nt, Homo sapiens
cgaauccaccacgaacaacuuc

SEQ ID NO: 4336 - RNA, 22 nt, Homo sapiens
agccacaaucaccuucugaucu

SEQ ID NO: 4337 - RNA, 20 nt, Homo sapiens
uaugaacaauuucuaggaau

SEQ ID NO: 4338 - RNA, 22 nt, Homo sapiens
ugugagccagccuggagcaccu

SEQ ID NO: 4339 - RNA, 22 nt, Homo sapiens
aaacagucuaccuacauugcuc

SEQ ID NO: 4340 - RNA, 22 nt, Homo sapiens
agacugcaggcccuagaggaca

SEQ ID NO: 4341 - RNA, 20 nt, Homo sapiens
ugucuugguuuuaugccuuu

SEQ ID NO: 4342 - RNA, 22 nt, Homo sapiens
ugccuccuccaggauccacaca

SEQ ID NO: 4343 - RNA, 21 nt, Homo sapiens
acauguccauauuaugcguua

SEQ ID NO: 4344 - RNA, 22 nt, Homo sapiens
uuugggacugaucuugaugucu

SEQ ID NO: 4345 - RNA, 22 nt, Homo sapiens
agacaucaagaucagucccaaa

SEQ ID NO: 4346 - RNA, 22 nt, Homo sapiens
acuucucauuuucugguuccuu

SEQ ID NO: 4347 - RNA, 22 nt, Homo sapiens
aauaagaccaucuuuuccucaa

SEQ ID NO: 4348 - RNA, 26 nt, Homo sapiens
cugagaaccagccauuucuuccucuu

SEQ ID NO: 4349 - RNA, 20 nt, Homo sapiens
cccaccugcucaguccgagc

SEQ ID NO: 4350 - RNA, 21 nt, Homo sapiens
agucuccaucugcggcccugu

SEQ ID NO: 4351 - RNA, 21 nt, Homo sapiens
acugaguccuuuguucucugc

SEQ ID NO: 4352 - RNA, 22 nt, Homo sapiens
ucagagaguuaagauaaucagu

SEQ ID NO: 4353 - RNA, 23 nt, Homo sapiens
acaaggcauaugguacucagaga

SEQ ID NO: 4354 - RNA, 22 nt, Homo sapiens
aaagagucaagucaaggccaga

SEQ ID NO: 4355 - RNA, 23 nt, Homo sapiens
ugcugugggaccucuggccuuga

SEQ ID NO: 4356 - RNA, 22 nt, Homo sapiens
cccuaauccaacauuacuaguu

SEQ ID NO: 4357 - RNA, 22 nt, Homo sapiens
aguagcagucacauauacauau

SEQ ID NO: 4358 - RNA, 21 nt, Homo sapiens
caagagaacuaaaacuggagu

SEQ ID NO: 4359 - RNA, 22 nt, Homo sapiens
aggcuccacuuucaguucucuu

SEQ ID NO: 4360 - RNA, 21 nt, Homo sapiens
ucucugccugcuuuuuggcca

SEQ ID NO: 4361 - RNA, 22 nt, Homo sapiens
augccuaucaaauaucuaccug

SEQ ID NO: 4362 - RNA, 21 nt, Homo sapiens
acaggcagauaugugauaggc

SEQ ID NO: 4363 - RNA, 22 nt, Homo sapiens
gccgaagcuccaagguuccucc

SEQ ID NO: 4364 - RNA, 23 nt, Homo sapiens
aguggucuacucacaucagccuc

SEQ ID NO: 4365 - RNA, 22 nt, Homo sapiens
ucccagcugugcaaccugagca

SEQ ID NO: 4366 - RNA, 22 nt, Homo sapiens
cugccucaguuuccacaccuga

SEQ ID NO: 4367 - RNA, 22 nt, Homo sapiens
guggcuggugcucguaucuaca

SEQ ID NO: 4368 - RNA, 22 nt, Homo sapiens
ugcaucugccauacaccccuua

SEQ ID NO: 4369 - RNA, 23 nt, Homo sapiens
cccccauugcuacagccgccugu

SEQ ID NO: 4370 - RNA, 22 nt, Homo sapiens
ccggguuaucuacaagggaauu

SEQ ID NO: 4371 - RNA, 22 nt, Homo sapiens
gacauccuguggucugcgcgua

SEQ ID NO: 4372 - RNA, 22 nt, Homo sapiens
aagugggcugggauccgggcug

SEQ ID NO: 4373 - RNA, 20 nt, Homo sapiens
cagagcccgccccaacccac

SEQ ID NO: 4374 - RNA, 22 nt, Homo sapiens
uaugauccucaguuguguguaa

SEQ ID NO: 4375 - RNA, 21 nt, Homo sapiens
auguaauacuguuaucugaaa

SEQ ID NO: 4376 - RNA, 22 nt, Homo sapiens
auuucagguaacaguauugcuu

SEQ ID NO: 4377 - RNA, 23 nt, Homo sapiens
cgccaagugaagccugggggcua

SEQ ID NO: 4378 - RNA, 23 nt, Homo sapiens
ccggagcagcaggccagcccgaa

SEQ ID NO: 4379 - RNA, 21 nt, Homo sapiens
ucucgguuggccugcugcaca

SEQ ID NO: 4380 - RNA, 23 nt, Homo sapiens
auaucaacccucuccuaugcccu

SEQ ID NO: 4381 - RNA, 20 nt, Homo sapiens
cccccgccuccgccgccgcc

SEQ ID NO: 4382 - RNA, 22 nt, Homo sapiens
ugcccuggaacggggcuggcag

SEQ ID NO: 4383 - RNA, 23 nt, Homo sapiens
cuaaggcuaaugcuguacuuugu

SEQ ID NO: 4384 - RNA, 23 nt, Homo sapiens
gcauuaaccuuacaaugaccuuu

SEQ ID NO: 4385 - RNA, 22 nt, Homo sapiens
gugaaguagugcauuagccuca

SEQ ID NO: 4386 - RNA, 24 nt, Homo sapiens
acauuaaucuuccugcucucuaua

SEQ ID NO: 4387 - RNA, 23 nt, Homo sapiens
uaagguuaauuacgaugaagcac

SEQ ID NO: 4388 - RNA, 24 nt, Homo sapiens
acacccuggaugcaugcuuuccac

SEQ ID NO: 4389 - RNA, 22 nt, Homo sapiens
agggguucaccgagcaacauuc

SEQ ID NO: 4390 - RNA, 23 nt, Homo sapiens
augcaaaguugcucggguaaccu

SEQ ID NO: 4391 - RNA, 21 nt, Homo sapiens
acaggccaucuguguuauauu

SEQ ID NO: 4392 - RNA, 22 nt, Homo sapiens
gguuaguggaccguguuacaua

SEQ ID NO: 4393 - RNA, 21 nt, Homo sapiens
cguacgcuauacggucuacua

SEQ ID NO: 4394 - RNA, 23 nt, Homo sapiens
acggcuaguggaccaggugaagu

SEQ ID NO: 4395 - RNA, 23 nt, Homo sapiens
gcgcccaauuaaugucuguugau

SEQ ID NO: 4396 - RNA, 22 nt, Homo sapiens
gccuucugacccuaaguccagu

SEQ ID NO: 4397 - RNA, 23 nt, Homo sapiens
acugaggggccucagaccgagcu

SEQ ID NO: 4398 - RNA, 23 nt, Homo sapiens
aaagucucgcucucugccccuca

SEQ ID NO: 4399 - RNA, 21 nt, Homo sapiens
auagcagcgccucacguuuug

SEQ ID NO: 4400 - RNA, 22 nt, Homo sapiens
uucaaaacaugaauugcugcug

SEQ ID NO: 4401 - RNA, 17 nt, Homo sapiens
uuggcccuuuucucagg

SEQ ID NO: 4402 - RNA, 19 nt, Homo sapiens
uggugcugacucaguggcc

SEQ ID NO: 4403 - RNA, 18 nt, Homo sapiens
acccccuggacaugcccu

SEQ ID NO: 4404 - RNA, 22 nt, Homo sapiens
gggcggacacgacauucccgau

SEQ ID NO: 4405 - RNA, 23 nt, Homo sapiens
gagaugguggaguagcuccaggc

SEQ ID NO: 4406 - RNA, 17 nt, Homo sapiens
uccaucucugaacacug

SEQ ID NO: 4407 - RNA, 23 nt, Homo sapiens
ucaacgggagugaucgugucauu

SEQ ID NO: 4408 - RNA, 18 nt, Homo sapiens
accuucaucaggucagau

SEQ ID NO: 4409 - RNA, 18 nt, Homo sapiens
cucaguccccaccucugg

SEQ ID NO: 4410 - RNA, 17 nt, Homo sapiens
ccaaggcgguggcgggg

SEQ ID NO: 4411 - RNA, 22 nt, Homo sapiens
uccugaccccuagacccaacug

SEQ ID NO: 4412 - RNA, 19 nt, Homo sapiens
ugggacuccaugccccaag

SEQ ID NO: 4413 - RNA, 16 nt, Homo sapiens
ugggucccuguuuccu

SEQ ID NO: 4414 - RNA, 17 nt, Homo sapiens
cagguagucugaauguc

SEQ ID NO: 4415 - RNA, 18 nt, Homo sapiens
ggccaaggcacuuagaau

SEQ ID NO: 4416 - RNA, 17 nt, Homo sapiens
aaugaccaugacugagu

SEQ ID NO: 4417 - RNA, 19 nt, Homo sapiens
cccagagcugagcccacag

SEQ ID NO: 4418 - RNA, 16 nt, Homo sapiens
ggccaaggccuccuag

SEQ ID NO: 4419 - RNA, 16 nt, Homo sapiens
gugccaccgagcugga

SEQ ID NO: 4420 - RNA, 21 nt, Homo sapiens
cacauccugagaggaggagcc

SEQ ID NO: 4421 - RNA, 21 nt, Homo sapiens
gccagggcugucugugccugc

SEQ ID NO: 4422 - RNA, 20 nt, Homo sapiens
gcccuccccugacucccuga

SEQ ID NO: 4423 - RNA, 19 nt, Homo sapiens
ccccaccuuuucuuccccc

SEQ ID NO: 4424 - RNA, 18 nt, Homo sapiens
acaaucacuaguugaaug

SEQ ID NO: 4425 - RNA, 18 nt, Homo sapiens
cuguccaucagagaacac

SEQ ID NO: 4426 - RNA, 18 nt, Homo sapiens
cagggggagggacugcug

SEQ ID NO: 4427 - RNA, 17 nt, Homo sapiens
aaagaagugguaauugg

SEQ ID NO: 4428 - RNA, 17 nt, Homo sapiens
gcacaugagucacugag

SEQ ID NO: 4429 - RNA, 21 nt, Homo sapiens
guguacugugcucagaacugc

SEQ ID NO: 4430 - RNA, 18 nt, Homo sapiens
caagggcaaacccccuag

SEQ ID NO: 4431 - RNA, 16 nt, Homo sapiens
gaagccgggaggagag

SEQ ID NO: 4432 - RNA, 21 nt, Homo sapiens
gcucugcucagaacuacacuc

SEQ ID NO: 4433 - RNA, 18 nt, Homo sapiens
ccccccuccccgggaccc

SEQ ID NO: 4434 - RNA, 18 nt, Homo sapiens
uccuggaugcaaauuuua

SEQ ID NO: 4435 - RNA, 17 nt, Homo sapiens
aaacucgcugagcccca

SEQ ID NO: 4436 - RNA, 18 nt, Homo sapiens
auggggugaugugagccc

SEQ ID NO: 4437 - RNA, 18 nt, Homo sapiens
augagucggacucgccgc

SEQ ID NO: 4438 - RNA, 17 nt, Homo sapiens
gguaccaggaguggggu

SEQ ID NO: 4439 - RNA, 19 nt, Homo sapiens
aaagugcccucaagggaga

SEQ ID NO: 4440 - RNA, 17 nt, Homo sapiens
ggaaacucagcagacaa

SEQ ID NO: 4441 - RNA, 19 nt, Homo sapiens
ugauagcccugcacaaugc

SEQ ID NO: 4442 - RNA, 22 nt, Homo sapiens
acgguuuuaccagacaguauua

SEQ ID NO: 4443 - RNA, 19 nt, Homo sapiens
gagggaagaaaggagggca

SEQ ID NO: 4444 - RNA, 16 nt, Homo sapiens
agcuguuccugcugaa

SEQ ID NO: 4445 - RNA, 18 nt, Homo sapiens
ccaaggccggcccagggg

SEQ ID NO: 4446 - RNA, 17 nt, Homo sapiens
cuguuccugucaggcug

SEQ ID NO: 4447 - RNA, 17 nt, Homo sapiens
cccugcuguagacuccc

SEQ ID NO: 4448 - RNA, 18 nt, Homo sapiens
aaggaaaacauugcacug

SEQ ID NO: 4449 - RNA, 17 nt, Homo sapiens
ugagccugagcccacau

SEQ ID NO: 4450 - RNA, 16 nt, Homo sapiens
cacagacaggaaggca

SEQ ID NO: 4451 - RNA, 22 nt, Homo sapiens
cugccuccuccuccugucccag

SEQ ID NO: 4452 - RNA, 18 nt, Homo sapiens
gccucucaugucaccagc

SEQ ID NO: 4453 - RNA, 18 nt, Homo sapiens
gaaguaguccagcuccca

SEQ ID NO: 4454 - RNA, 20 nt, Homo sapiens
ucacaagugaaguaguggga

SEQ ID NO: 4455 - RNA, 18 nt, Homo sapiens
cucgcugagccacacugg

SEQ ID NO: 4456 - RNA, 17 nt, Homo sapiens
cuguccucagcucagaa

SEQ ID NO: 4457 - RNA, 17 nt, Homo sapiens
ugcccuggacaugccgg

SEQ ID NO: 4458 - RNA, 18 nt, Homo sapiens
gaacuggaggugucuagg

SEQ ID NO: 4459 - RNA, 17 nt, Homo sapiens
uacugccuuucucucca

SEQ ID NO: 4460 - RNA, 19 nt, Homo sapiens
ggaaacaggaaaaaacauu

SEQ ID NO: 4461 - RNA, 18 nt, Homo sapiens
aagaagaaacuccaggga

SEQ ID NO: 4462 - RNA, 18 nt, Homo sapiens
uggaauccuagacuccag

SEQ ID NO: 4463 - RNA, 16 nt, Homo sapiens
gggacaugaaugcugc

SEQ ID NO: 4464 - RNA, 18 nt, Homo sapiens
cacacucagcucucuuuc

SEQ ID NO: 4465 - RNA, 19 nt, Homo sapiens
uggggacaggaacaaggcc

SEQ ID NO: 4466 - RNA, 20 nt, Homo sapiens
ggguuuggggccagggggcu

SEQ ID NO: 4467 - RNA, 22 nt, Homo sapiens
agaagcccugcaagacgaccug

SEQ ID NO: 4468 - RNA, 18 nt, Homo sapiens
cugucccauuucccagag

SEQ ID NO: 4469 - RNA, 18 nt, Homo sapiens
guccagcucagaaagcgg

SEQ ID NO: 4470 - RNA, 21 nt, Homo sapiens
ugcaugacggccugcaagaca

SEQ ID NO: 4471 - RNA, 17 nt, Homo sapiens
caccagcuagccucacc

SEQ ID NO: 4472 - RNA, 17 nt, Homo sapiens
aaacucccuggcaaugu

SEQ ID NO: 4473 - RNA, 17 nt, Homo sapiens
agcauguacccacagug

SEQ ID NO: 4474 - RNA, 17 nt, Homo sapiens
guggcuuugcucaggga

SEQ ID NO: 4475 - RNA, 18 nt, Homo sapiens
aggaagcuacagaauccc

SEQ ID NO: 4476 - RNA, 21 nt, Homo sapiens
cgcagggcgguccaccgcuaa

SEQ ID NO: 4477 - RNA, 21 nt, Homo sapiens
ccccacgcgcugagcccacag

SEQ ID NO: 4478 - RNA, 18 nt, Homo sapiens
ucugaggcuguggggcug

SEQ ID NO: 4479 - RNA, 21 nt, Homo sapiens
agacauggaggagccauccag

SEQ ID NO: 4480 - RNA, 20 nt, Homo sapiens
uuaagguuagggucucaggg

SEQ ID NO: 4481 - RNA, 18 nt, Homo sapiens
ucacugagacaagugcaa

SEQ ID NO: 4482 - RNA, 23 nt, Homo sapiens
ccacccaaugaccuacuccaaga

SEQ ID NO: 4483 - RNA, 20 nt, Homo sapiens
gucugggagacagaggaaca

SEQ ID NO: 4484 - RNA, 19 nt, Homo sapiens
ccagucccccaugcaagcc

SEQ ID NO: 4485 - RNA, 17 nt, Homo sapiens
aauccugggaaaacugg

SEQ ID NO: 4486 - RNA, 19 nt, Homo sapiens
guggaacuagggucucagg

SEQ ID NO: 4487 - RNA, 22 nt, Homo sapiens
acaccgaggagcccaucaugau

SEQ ID NO: 4488 - RNA, 19 nt, Homo sapiens
gcaaggcucugaucugagg

SEQ ID NO: 4489 - RNA, 18 nt, Homo sapiens
cccuccgggaagcccacc

SEQ ID NO: 4490 - RNA, 18 nt, Homo sapiens
cugcugaguccugcagug

SEQ ID NO: 4491 - RNA, 17 nt, Homo sapiens
ugcagucuccucccuca

SEQ ID NO: 4492 - RNA, 18 nt, Homo sapiens
ccaucuuccuucagccuc

SEQ ID NO: 4493 - RNA, 22 nt, Homo sapiens
cucagcuacagacaucagugac

SEQ ID NO: 4494 - RNA, 22 nt, Homo sapiens
uagcuccuuuccacagacaggu

SEQ ID NO: 4495 - RNA, 21 nt, Homo sapiens
uggguacuuccugaugcuuuu

SEQ ID NO: 4496 - RNA, 21 nt, Homo sapiens
uuguugcuuuuuggugccuau

SEQ ID NO: 4497 - RNA, 22 nt, Homo sapiens
gcaugggaacaaaaaggcaacu

SEQ ID NO: 4498 - RNA, 22 nt, Homo sapiens
uaguccauuuugaguuaacucu

SEQ ID NO: 4499 - RNA, 22 nt, Homo sapiens
augguccugcugaaucccaaca

SEQ ID NO: 4500 - RNA, 17 nt, Homo sapiens
aaaguacguccaucuuc

SEQ ID NO: 4501 - RNA, 21 nt, Homo sapiens
acucuucagacucuauucaga

SEQ ID NO: 4502 - RNA, 22 nt, Homo sapiens
gcuccauguucccgucuccuug

SEQ ID NO: 4503 - RNA, 20 nt, Homo sapiens
cgccucucagcccagcuuuu

SEQ ID NO: 4504 - RNA, 18 nt, Homo sapiens
cuccgcucacuccagccu

SEQ ID NO: 4505 - RNA, 22 nt, Homo sapiens
accuucuaguuuucagagucgc

SEQ ID NO: 4506 - RNA, 20 nt, Homo sapiens
aggcaucuugcagagucuuu

SEQ ID NO: 4507 - RNA, 21 nt, Homo sapiens
augucccacccccacuccugu

SEQ ID NO: 4508 - RNA, 21 nt, Homo sapiens
acaggaguggggggugggacg

SEQ ID NO: 4509 - RNA, 18 nt, Homo sapiens
uucuacuuuacuucuccu

SEQ ID NO: 4510 - RNA, 22 nt, Homo sapiens
ccucugugugagcucuggccau

SEQ ID NO: 4511 - RNA, 21 nt, Homo sapiens
auccacuucugccuguccugc

SEQ ID NO: 4512 - RNA, 22 nt, Homo sapiens
uuguccacuucuuccugcccug

SEQ ID NO: 4513 - RNA, 22 nt, Homo sapiens
ggcagggcaggcagaaguggac

SEQ ID NO: 4514 - RNA, 21 nt, Homo sapiens
aaccuuuguacccugagccca

SEQ ID NO: 4515 - RNA, 21 nt, Homo sapiens
acugucuuuucuaagccugug

SEQ ID NO: 4516 - RNA, 22 nt, Homo sapiens
augccuccaagguaucagucac

SEQ ID NO: 4517 - RNA, 22 nt, Homo sapiens
caagccagcaagccccacgaca

SEQ ID NO: 4518 - RNA, 17 nt, Homo sapiens
uacaaucuccucccugu

SEQ ID NO: 4519 - RNA, 17 nt, Homo sapiens
ccucccucuuguccggc

SEQ ID NO: 4520 - RNA, 17 nt, Homo sapiens
aaaacccacgccuccaa

SEQ ID NO: 4521 - RNA, 18 nt, Homo sapiens
cgccucuuccaacucgag

SEQ ID NO: 4522 - RNA, 21 nt, Homo sapiens
uggauuguuucuuuugccgug

SEQ ID NO: 4523 - RNA, 22 nt, Homo sapiens
ugcacggcaaaagaaacaaucu

SEQ ID NO: 4524 - RNA, 22 nt, Homo sapiens
acccaugucacugccagcccug

SEQ ID NO: 4525 - RNA, 22 nt, Homo sapiens
gccaagggaauggcagggaaau

SEQ ID NO: 4526 - RNA, 17 nt, Homo sapiens
aaacaacagcccccacc

SEQ ID NO: 4527 - RNA, 20 nt, Homo sapiens
uaccccuagaccaaggagcc

SEQ ID NO: 4528 - RNA, 22 nt, Homo sapiens
ugccucgcgcagccccgggacg

SEQ ID NO: 4529 - RNA, 22 nt, Homo sapiens
ucaccacuucuccaaaucccca

SEQ ID NO: 4530 - RNA, 17 nt, Homo sapiens
uguccucagcucuacca

SEQ ID NO: 4531 - RNA, 23 nt, Homo sapiens
aucacuuaaggccaagaauucaa

SEQ ID NO: 4532 - RNA, 20 nt, Homo sapiens
aaccgcuacagaccaagcuc

SEQ ID NO: 4533 - RNA, 20 nt, Homo sapiens
uggugccgugacucggaucc

SEQ ID NO: 4534 - RNA, 17 nt, Homo sapiens
aaaaacacacacacccu

SEQ ID NO: 4535 - RNA, 17 nt, Homo sapiens
aaaaggaagccaccagg

SEQ ID NO: 4536 - RNA, 22 nt, Homo sapiens
uacgccagucaauaccuuguga

SEQ ID NO: 4537 - RNA, 19 nt, Homo sapiens
uucuuccacaccuaccucu

SEQ ID NO: 4538 - RNA, 22 nt, Homo sapiens
cuccaccuccuccgccuccugg

SEQ ID NO: 4539 - RNA, 22 nt, Homo sapiens
aagguaaauucacaaccacuau

SEQ ID NO: 4540 - RNA, 23 nt, Homo sapiens
gccuagcccuacuagucucaauc

SEQ ID NO: 4541 - RNA, 23 nt, Homo sapiens
uucccaagccacccuccguguca

SEQ ID NO: 4542 - RNA, 17 nt, Homo sapiens
ggccccaccccagucuc

SEQ ID NO: 4543 - RNA, 21 nt, Homo sapiens
uauugcaucuauccaaaccuu

SEQ ID NO: 4544 - RNA, 22 nt, Homo sapiens
uccccuggucagacuacuugag

SEQ ID NO: 4545 - RNA, 18 nt, Homo sapiens
ccccgccggcccgcaccc

SEQ ID NO: 4546 - RNA, 22 nt, Homo sapiens
aagcccauaacuaccgccgcca

SEQ ID NO: 4547 - RNA, 18 nt, Homo sapiens
aucucauccuucugcucu

SEQ ID NO: 4548 - RNA, 22 nt, Homo sapiens
uccgagcgacccuagagggagc

SEQ ID NO: 4549 - RNA, 21 nt, Homo sapiens
ucucggcuuccacguuugcca

SEQ ID NO: 4550 - RNA, 22 nt, Homo sapiens
ugggaacuuaguagagguuuaa

SEQ ID NO: 4551 - RNA, 18 nt, Homo sapiens
ggugggggguguuguuuu

SEQ ID NO: 4552 - RNA, 22 nt, Homo sapiens
cuagugcucuccguuacaagua

SEQ ID NO: 4553 - RNA, 22 nt, Homo sapiens
uuguggcuggucaugaggcuaa

SEQ ID NO: 4554 - RNA, 21 nt, Homo sapiens
uuagucucaugaucagacaca

SEQ ID NO: 4555 - RNA, 22 nt, Homo sapiens
caagggaccaagcauucauuau

SEQ ID NO: 4556 - RNA, 22 nt, Homo sapiens
caggaaggauuuagggacaggc

SEQ ID NO: 4557 - RNA, 22 nt, Homo sapiens
cuauuaaggacauuugugauuc

SEQ ID NO: 4558 - RNA, 22 nt, Homo sapiens
auuaaggacauuugugauugau

SEQ ID NO: 4559 - RNA, 17 nt, Homo sapiens
gaggcugagcugaggag

SEQ ID NO: 4560 - RNA, 22 nt, Homo sapiens
cgcgcggccgugcucggagcag

SEQ ID NO: 4561 - RNA, 22 nt, Homo sapiens
uugcauauguaggaugucccau

SEQ ID NO: 4562 - RNA, 21 nt, Homo sapiens
agccaaguggaaguuacuuua

SEQ ID NO: 4563 - RNA, 17 nt, Homo sapiens
ggagugggcuggugguu

SEQ ID NO: 4564 - RNA, 22 nt, Homo sapiens
uuucuauuucucaguggggcuc

SEQ ID NO: 4565 - RNA, 22 nt, Homo sapiens
aacccagugggcuauggaaaug

SEQ ID NO: 4566 - RNA, 17 nt, Homo sapiens
gggguggucuguuguug

SEQ ID NO: 4567 - RNA, 20 nt, Homo sapiens
aaaaggcgggagaagcccca

SEQ ID NO: 4568 - RNA, 20 nt, Homo sapiens
uaacggccgcgguacccuaa

SEQ ID NO: 4569 - RNA, 17 nt, Homo sapiens
gcugggcgaggcuggca

SEQ ID NO: 4570 - RNA, 19 nt, Homo sapiens
agagcuggcugaagggcag

SEQ ID NO: 4571 - RNA, 18 nt, Homo sapiens
agggggcgggcuccggcg

SEQ ID NO: 4572 - RNA, 21 nt, Homo sapiens
uggggcuagugaugcaggacg

SEQ ID NO: 4573 - RNA, 22 nt, Homo sapiens
ucugguaagagauuugggcaua

SEQ ID NO: 4574 - RNA, 22 nt, Homo sapiens
aauguggacuggugugaccaaa

SEQ ID NO: 4575 - RNA, 17 nt, Homo sapiens
ggggcugggcgcgcgcc

SEQ ID NO: 4576 - RNA, 21 nt, Homo sapiens
agaaggccuuuccaucucugu

SEQ ID NO: 4577 - RNA, 22 nt, Homo sapiens
ccagacuguggcugaccagagg

SEQ ID NO: 4578 - RNA, 21 nt, Homo sapiens
aauguaaacaggcuuuuugcu

SEQ ID NO: 4579 - RNA, 22 nt, Homo sapiens
gaggaaacugaagcugagaggg

SEQ ID NO: 4580 - RNA, 17 nt, Homo sapiens
cuccgggacggcugggc

SEQ ID NO: 4581 - RNA, 22 nt, Homo sapiens
ugggcuggcagggcaagugcug

SEQ ID NO: 4582 - RNA, 17 nt, Homo sapiens
aagacugagaggaggga

SEQ ID NO: 4583 - RNA, 22 nt, Homo sapiens
uggcaguguauuguuagcuggu

SEQ ID NO: 4584 - RNA, 22 nt, Homo sapiens
cagccacaacuacccugccacu

SEQ ID NO: 4585 - RNA, 22 nt, Homo sapiens
aggcaguguauuguuagcuggc

SEQ ID NO: 4586 - RNA, 23 nt, Homo sapiens
uugcuaguugcacuccucucugu

SEQ ID NO: 4587 - RNA, 25 nt, Homo sapiens
uaggcaguguauugcuagcggcugu

SEQ ID NO: 4588 - RNA, 17 nt, Homo sapiens
ugagguaguaguuucuu

SEQ ID NO: 4589 - RNA, 21 nt, Homo sapiens
uaugugaccucggaugaauca

SEQ ID NO: 4590 - RNA, 22 nt, Homo sapiens
gcugaugaugauggugcugaag

SEQ ID NO: 4591 - RNA, 22 nt, Homo sapiens
uuuaagcaggaaauagaauuua

SEQ ID NO: 4592 - RNA, 22 nt, Homo sapiens
ugugacaauagagaugaacaug

SEQ ID NO: 4593 - RNA, 18 nt, Homo sapiens
aggcugggcugggacgga

SEQ ID NO: 4594 - RNA, 20 nt, Homo sapiens
aaauggguggucugaggcaa

SEQ ID NO: 4595 - RNA, 20 nt, Homo sapiens
cuggguugggcugggcuggg

SEQ ID NO: 4596 - RNA, 17 nt, Homo sapiens
gcggggcugggcgcgcg

SEQ ID NO: 4597 - RNA, 22 nt, Homo sapiens
acuaaaggauauagaagguuuu

SEQ ID NO: 4598 - RNA, 22 nt, Homo sapiens
auuggggacauuuugcauucau

SEQ ID NO: 4599 - RNA, 22 nt, Homo sapiens
uuuugcgauguguuccuaauau

SEQ ID NO: 4600 - RNA, 22 nt, Homo sapiens
uugggaucauuuugcauccaua

SEQ ID NO: 4601 - RNA, 22 nt, Homo sapiens
uuuugcaauauguuccugaaua

SEQ ID NO: 4602 - RNA, 22 nt, Homo sapiens
ugagggaguaggauguaugguu

SEQ ID NO: 4603 - RNA, 22 nt, Homo sapiens
gaagaacuguugcauuugcccu

SEQ ID NO: 4604 - RNA, 22 nt, Homo sapiens
cagggccucacuguaucgccca

SEQ ID NO: 4605 - RNA, 22 nt, Homo sapiens
agacugacggcuggaggcccau

SEQ ID NO: 4606 - RNA, 18 nt, Homo sapiens
acaggcaggauuggggaa

SEQ ID NO: 4607 - RNA, 22 nt, Homo sapiens
aggacuggacucccggcagccc

SEQ ID NO: 4608 - RNA, 17 nt, Homo sapiens
gggagaagggucggggc

SEQ ID NO: 4609 - RNA, 25 nt, Homo sapiens
aaauaugaugaaacucacagcugag

SEQ ID NO: 4610 - RNA, 26 nt, Homo sapiens
gcucagggaugauaacugugcugaga

SEQ ID NO: 4611 - RNA, 18 nt, Homo sapiens
cagcagugcgcagggcug

SEQ ID NO: 4612 - RNA, 22 nt, Homo sapiens
aaaccguuaccauuacugaguu

SEQ ID NO: 4613 - RNA, 22 nt, Homo sapiens
uagcaagagaaccauuaccauu

SEQ ID NO: 4614 - RNA, 22 nt, Homo sapiens
uuggacagaaaacacgcaggaa

SEQ ID NO: 4615 - RNA, 20 nt, Homo sapiens
ccugcguguuuucuguccaa

SEQ ID NO: 4616 - RNA, 22 nt, Homo sapiens
uuuggacagaaaacacgcaggu

SEQ ID NO: 4617 - RNA, 20 nt, Homo sapiens
ccugcguguuuucuguccaa

SEQ ID NO: 4618 - RNA, 22 nt, Homo sapiens
gcuaaggaaguccugugcucag

SEQ ID NO: 4619 - RNA, 21 nt, Homo sapiens
ugacucugccuguaggccggu

SEQ ID NO: 4620 - RNA, 21 nt, Homo sapiens
gaccgagagggccucggcugu

SEQ ID NO: 4621 - RNA, 22 nt, Homo sapiens
cucaucugcaaagaaguaagug

SEQ ID NO: 4622 - RNA, 22 nt, Homo sapiens
ugagacaggcuuaugcugcuau

SEQ ID NO: 4623 - RNA, 22 nt, Homo sapiens
auagcagcaugaaccugucuca

SEQ ID NO: 4624 - RNA, 20 nt, Homo sapiens
gagacagguucaugcugcua

SEQ ID NO: 4625 - RNA, 21 nt, Homo sapiens
auagcagcauaagccugucuc

SEQ ID NO: 4626 - RNA, 21 nt, Homo sapiens
ggggggaugugcaugcugguu

SEQ ID NO: 4627 - RNA, 22 nt, Homo sapiens
aacuguuugcagaggaaacuga

SEQ ID NO: 4628 - RNA, 22 nt, Homo sapiens
gcugacagcagggcuggccgcu

SEQ ID NO: 4629 - RNA, 22 nt, Homo sapiens
uggucugcaaagagaugacugu

SEQ ID NO: 4630 - RNA, 22 nt, Homo sapiens
ucauuauauguaugaucuggac

SEQ ID NO: 4631 - RNA, 21 nt, Homo sapiens
auuggacugcugauggcccgu

SEQ ID NO: 4632 - RNA, 22 nt, Homo sapiens
aggccaucagcaguccaaugaa

SEQ ID NO: 4633 - RNA, 18 nt, Homo sapiens
cccagcaggacgggagcg

SEQ ID NO: 4634 - RNA, 17 nt, Homo sapiens
auggagaaggcuucuga

SEQ ID NO: 4635 - RNA, 17 nt, Homo sapiens
ccccggggagcccggcg

SEQ ID NO: 4636 - RNA, 22 nt, Homo sapiens
uggaaggagguugccggacgcu

SEQ ID NO: 4637 - RNA, 17 nt, Homo sapiens
ggauggaggaggggucu

SEQ ID NO: 4638 - RNA, 17 nt, Homo sapiens
guggaccuggcugggac

SEQ ID NO: 4639 - RNA, 21 nt, Homo sapiens
ucgugcauauaucuaccacau

SEQ ID NO: 4640 - RNA, 21 nt, Homo sapiens
ugugguagauauaugcacgau

SEQ ID NO: 4641 - RNA, 22 nt, Homo sapiens
ugagccgagcugagcuuagcug

SEQ ID NO: 4642 - RNA, 22 nt, Homo sapiens
gagcuuggaugagcugggcuga

SEQ ID NO: 4643 - RNA, 22 nt, Homo sapiens
gcugaacugggcugagcugggc

SEQ ID NO: 4644 - RNA, 21 nt, Homo sapiens
uuaguccugccuguagguuua

SEQ ID NO: 4645 - RNA, 23 nt, Homo sapiens
uagugcaauauugcuuauagggu

SEQ ID NO: 4646 - RNA, 22 nt, Homo sapiens
acccuaucaauauugucucugc

SEQ ID NO: 4647 - RNA, 21 nt, Homo sapiens
gcaguccaugggcauauacac

SEQ ID NO: 4648 - RNA, 22 nt, Homo sapiens
uaugugccuuuggacuacaucg

SEQ ID NO: 4649 - RNA, 22 nt, Homo sapiens
ugccgcccucucgcugcucuag

SEQ ID NO: 4650 - RNA, 23 nt, Homo sapiens
gagggcagcguggguguggcgga

SEQ ID NO: 4651 - RNA, 22 nt, Homo sapiens
aggagcuagccaggcauaugca

SEQ ID NO: 4652 - RNA, 20 nt, Homo sapiens
auaugccuggcuagcuccuc

SEQ ID NO: 4653 - RNA, 19 nt, Homo sapiens
cggcgcgaccggcccgggg

SEQ ID NO: 4654 - RNA, 21 nt, Homo sapiens
ucuugaagucagaacccgcaa

SEQ ID NO: 4655 - RNA, 22 nt, Homo sapiens
aacucguguucaaagccuuuag

SEQ ID NO: 4656 - RNA, 22 nt, Homo sapiens
uacuaacugcagauucaaguga

SEQ ID NO: 4657 - RNA, 23 nt, Homo sapiens
ccuggacaccgcucagccggccg

SEQ ID NO: 4658 - RNA, 21 nt, Homo sapiens
acucggcugcgguggacaagu

SEQ ID NO: 4659 - RNA, 20 nt, Homo sapiens
ucacucucaccuugcuuugc

SEQ ID NO: 4660 - RNA, 22 nt, Homo sapiens
uugcuaaguaggcugagauuga

SEQ ID NO: 4661 - RNA, 22 nt, Homo sapiens
cacccccuguuuccuggcccac

SEQ ID NO: 4662 - RNA, 23 nt, Homo sapiens
ugggccagggagcagcugguggg

SEQ ID NO: 4663 - RNA, 24 nt, Homo sapiens
ugcccaugccauacuuuugccuca

SEQ ID NO: 4664 - RNA, 22 nt, Homo sapiens
auggcaucguccccugguggcu

SEQ ID NO: 4665 - RNA, 22 nt, Homo sapiens
gacacaugaccauaaaugcuaa

SEQ ID NO: 4666 - RNA, 23 nt, Homo sapiens
uggagagagaaaagagacagaag

SEQ ID NO: 4667 - RNA, 22 nt, Homo sapiens
agacaguaguucuugccugguu

SEQ ID NO: 4668 - RNA, 19 nt, Homo sapiens
accaggcaagaaauauugu

SEQ ID NO: 4669 - RNA, 21 nt, Homo sapiens
auugucccucucccuucccag

SEQ ID NO: 4670 - RNA, 22 nt, Homo sapiens
acugggaagaggagcugaggga

SEQ ID NO: 4671 - RNA, 23 nt, Homo sapiens
gaagauggugcugugcugaggaa

SEQ ID NO: 4672 - RNA, 20 nt, Homo sapiens
ugugggacugcaaaugggag

SEQ ID NO: 4673 - RNA, 21 nt, Homo sapiens
ucugaggccugccucucccca

SEQ ID NO: 4674 - RNA, 24 nt, Homo sapiens
ugggcgaggggugggcucucagag

SEQ ID NO: 4675 - RNA, 21 nt, Homo sapiens
agguagaaugaggccugacau

SEQ ID NO: 4676 - RNA, 19 nt, Homo sapiens
ucaggccucuuucuaccuu

SEQ ID NO: 4677 - RNA, 20 nt, Homo sapiens
cggggugggugaggucgggc

SEQ ID NO: 4678 - RNA, 22 nt, Homo sapiens
guucuguuaacccauccccuca

SEQ ID NO: 4679 - RNA, 22 nt, Homo sapiens
aggggacugguuaauagaacua

SEQ ID NO: 4680 - RNA, 23 nt, Homo sapiens
uggaguuaaggguugcuuggaga

SEQ ID NO: 4681 - RNA, 22 nt, Homo sapiens
ucucugagcaaggcuuaacacc

SEQ ID NO: 4682 - RNA, 22 nt, Homo sapiens
ugugggaucuggaggcaucugg

SEQ ID NO: 4683 - RNA, 21 nt, Homo sapiens
acccucgucagguccccgggg

SEQ ID NO: 4684 - RNA, 22 nt, Homo sapiens
caccggggauggcagagggucg

SEQ ID NO: 4685 - RNA, 23 nt, Homo sapiens
ugggcugagggcaggaggccugu

SEQ ID NO: 4686 - RNA, 23 nt, Homo sapiens
aauguggaaguggucugaggcau

SEQ ID NO: 4687 - RNA, 23 nt, Homo sapiens
gugaguguggauccuggaggaau

SEQ ID NO: 4688 - RNA, 22 nt, Homo sapiens
uuucuucuuagacauggcaacg

SEQ ID NO: 4689 - RNA, 22 nt, Homo sapiens
cugccaugucuaagaagaaaac

SEQ ID NO: 4690 - RNA, 22 nt, Homo sapiens
uuucuucuuagacauggcagcu

SEQ ID NO: 4691 - RNA, 19 nt, Homo sapiens
uugccaugucuaagaagaa

SEQ ID NO: 4692 - RNA, 23 nt, Homo sapiens
auacacauacacgcaacacacau

SEQ ID NO: 4693 - RNA, 23 nt, Homo sapiens
ugcagcucugguggaaaauggag

SEQ ID NO: 4694 - RNA, 22 nt, Homo sapiens
caggauccacagagcuagucca

SEQ ID NO: 4695 - RNA, 22 nt, Homo sapiens
aacuagcucuguggauccugac

SEQ ID NO: 4696 - RNA, 22 nt, Homo sapiens
aaagauagacaauuggcuaaau

SEQ ID NO: 4697 - RNA, 22 nt, Homo sapiens
uuagccaauuguccaucuuuag

SEQ ID NO: 4698 - RNA, 22 nt, Homo sapiens
aaagauggacaauuggcuaaau

SEQ ID NO: 4699 - RNA, 24 nt, Homo sapiens
agcugagcuccauggacgugcagu

SEQ ID NO: 4700 - RNA, 22 nt, Homo sapiens
cuuccggucugugagccccguc

SEQ ID NO: 4701 - RNA, 22 nt, Homo sapiens
uggggugcccacuccgcaaguu

SEQ ID NO: 4702 - RNA, 26 nt, Homo sapiens
cucggccgcggcgcguagcccccgcc

SEQ ID NO: 4703 - RNA, 23 nt, Homo sapiens
cugggggacgcgugagcgcgagc

SEQ ID NO: 4704 - RNA, 21 nt, Homo sapiens
cauacaaucugacauguauuu

SEQ ID NO: 4705 - RNA, 21 nt, Homo sapiens
auacaugucagauuguaugcc

SEQ ID NO: 4706 - RNA, 23 nt, Homo sapiens
uugcaugucagauuguaauuccc

SEQ ID NO: 4707 - RNA, 21 nt, Homo sapiens
ucccuccuucuguccccacag

SEQ ID NO: 4708 - RNA, 22 nt, Homo sapiens
acuggggagcagaaggagaacc

SEQ ID NO: 4709 - RNA, 23 nt, Homo sapiens
gaaaauccuuuuuguuuuuccag

SEQ ID NO: 4710 - RNA, 23 nt, Homo sapiens
agggaaaaaaaaaaggauuuguc

SEQ ID NO: 4711 - RNA, 22 nt, Homo sapiens
uguguccgggaaguggaggagg

SEQ ID NO: 4712 - RNA, 22 nt, Homo sapiens
ugaaguuacaucauggucgcuu

SEQ ID NO: 4713 - RNA, 22 nt, Homo sapiens
aagcgaccaugauguaacuuca

SEQ ID NO: 4714 - RNA, 21 nt, Homo sapiens
uuagugcauagucuuuggucu

SEQ ID NO: 4715 - RNA, 22 nt, Homo sapiens
accgaagacugugcgcuaaucu

SEQ ID NO: 4716 - RNA, 21 nt, Homo sapiens
uuacacagcuggacagaggca

SEQ ID NO: 4717 - RNA, 22 nt, Homo sapiens
uccaggcaggagccggacugga

SEQ ID NO: 4718 - RNA, 21 nt, Homo sapiens
cugggcucgggacgcgcggcu

SEQ ID NO: 4719 - RNA, 22 nt, Homo sapiens
ggggcugugauugaccagcagg

SEQ ID NO: 4720 - RNA, 22 nt, Homo sapiens
cacuguuucaccacuggcucuu

SEQ ID NO: 4721 - RNA, 21 nt, Homo sapiens
gagccaguggugagacaguga

SEQ ID NO: 4722 - RNA, 22 nt, Homo sapiens
ucugugagaccaaagaacuacu

SEQ ID NO: 4723 - RNA, 22 nt, Homo sapiens
uuguucuuuggucuuucagcca

SEQ ID NO: 4724 - RNA, 22 nt, Homo sapiens
aagguauuguucagacuuauga

SEQ ID NO: 4725 - RNA, 22 nt, Homo sapiens
ucugugauagagauucuuugcu

SEQ ID NO: 4726 - RNA, 21 nt, Homo sapiens
ucugaauuguaagaguuguua

SEQ ID NO: 4727 - RNA, 23 nt, Homo sapiens
agaacucuugcagucuuagaugu

SEQ ID NO: 4728 - RNA, 22 nt, Homo sapiens
aacgggaaugcaggcuguaucu

SEQ ID NO: 4729 - RNA, 23 nt, Homo sapiens
ucugaguuccuggagccuggucu

SEQ ID NO: 4730 - RNA, 23 nt, Homo sapiens
uggagauccagugcucgcccgau

SEQ ID NO: 4731 - RNA, 22 nt, Homo sapiens
uguugcaagucgguggagacgu

SEQ ID NO: 4732 - RNA, 22 nt, Homo sapiens
cucucuacugacuugcaacaua

SEQ ID NO: 4733 - RNA, 22 nt, Homo sapiens
ucucccuuccugcccuggcuag

SEQ ID NO: 4734 - RNA, 26 nt, Homo sapiens
cccagggcuuggaguggggcaagguu

SEQ ID NO: 4735 - RNA, 23 nt, Homo sapiens
uaucugcugggcuuucugguguu

SEQ ID NO: 4736 - RNA, 21 nt, Homo sapiens
uggcuguuggagggggcaggc

SEQ ID NO: 4737 - RNA, 22 nt, Homo sapiens
cagcccuccucccgcacccaaa

SEQ ID NO: 4738 - RNA, 22 nt, Homo sapiens
uaggggcagcagaggaccuggg

SEQ ID NO: 4739 - RNA, 22 nt, Homo sapiens
uugaggagacauggugggggcc

SEQ ID NO: 4740 - RNA, 21 nt, Homo sapiens
gcagcccagcugaggccucug

SEQ ID NO: 4741 - RNA, 22 nt, Homo sapiens
gagcaggcgaggcugggcugaa

SEQ ID NO: 4742 - RNA, 23 nt, Homo sapiens
ccagccacggacugagagugcau

SEQ ID NO: 4743 - RNA, 23 nt, Homo sapiens
guccuccaggccaugagcugcgg

SEQ ID NO: 4744 - RNA, 22 nt, Homo sapiens
ucaggcaguguggguaucagau

SEQ ID NO: 4745 - RNA, 23 nt, Homo sapiens
ugagaguggaauucacaguauuu

SEQ ID NO: 4746 - RNA, 23 nt, Homo sapiens
auacugugaauuucacugucaca

SEQ ID NO: 4747 - RNA, 21 nt, Homo sapiens
caaauggacaggauaacaccu

SEQ ID NO: 4748 - RNA, 22 nt, Homo sapiens
agguguuauccuauccauuugc

SEQ ID NO: 4749 - RNA, 22 nt, Homo sapiens
ugaucucaccgcugccuccuuc

SEQ ID NO: 4750 - RNA, 22 nt, Homo sapiens
caggaggcagugggcgagcagg

SEQ ID NO: 4751 - RNA, 22 nt, Homo sapiens
ugcaagacggauacugucaucu

SEQ ID NO: 4752 - RNA, 24 nt, Homo sapiens
ugucagugacuccugccccuuggu

SEQ ID NO: 4753 - RNA, 22 nt, Homo sapiens
agggggcgcagucacugacgug

SEQ ID NO: 4754 - RNA, 23 nt, Homo sapiens
ucaaaauguagaggaagacccca

SEQ ID NO: 4755 - RNA, 22 nt, Homo sapiens
aauuuacucugcaaucuucucc

SEQ ID NO: 4756 - RNA, 22 nt, Homo sapiens
agaagauugcagaguaaguucc

SEQ ID NO: 4757 - RNA, 26 nt, Homo sapiens
cacaggacugacuccucaccccagug

SEQ ID NO: 4758 - RNA, 22 nt, Homo sapiens
ucuggggaugaggacagugugu

SEQ ID NO: 4759 - RNA, 20 nt, Homo sapiens
augggugauggguguggugu

SEQ ID NO: 4760 - RNA, 22 nt, Homo sapiens
uuggccaccacaccuaccccuu

SEQ ID NO: 4761 - RNA, 22 nt, Homo sapiens
uguaguuguauuguauugccac

SEQ ID NO: 4762 - RNA, 23 nt, Homo sapiens
uagcaauacaguacaaauauagu

SEQ ID NO: 4763 - RNA, 22 nt, Homo sapiens
ucagucacauaucuagugucua

SEQ ID NO: 4764 - RNA, 22 nt, Homo sapiens
gacacuaggcaugugagugauu

SEQ ID NO: 4765 - RNA, 22 nt, Homo sapiens
ucaaucacuugguaauugcugu

SEQ ID NO: 4766 - RNA, 25 nt, Homo sapiens
agcggggaggaagugggcgcugcuu

SEQ ID NO: 4767 - RNA, 22 nt, Homo sapiens
agcccgccccagccgagguucu

SEQ ID NO: 4768 - RNA, 23 nt, Homo sapiens
gccccggcgcgggcggguucugg

SEQ ID NO: 4769 - RNA, 22 nt, Homo sapiens
agcaaggcggcaucucucugau

SEQ ID NO: 4770 - RNA, 21 nt, Homo sapiens
agagaugccgccuugcuccuu

SEQ ID NO: 4771 - RNA, 23 nt, Homo sapiens
uugaagaggaggugcucuguagc

SEQ ID NO: 4772 - RNA, 22 nt, Homo sapiens
acaacagugacuugcucuccaa

SEQ ID NO: 4773 - RNA, 18 nt, Homo sapiens
gggugagggcaggugguu

SEQ ID NO: 4774 - RNA, 18 nt, Homo sapiens
cgugucuucuggcuugau

SEQ ID NO: 4775 - RNA, 23 nt, Homo sapiens
ugcaucaggccagaagacaugag

SEQ ID NO: 4776 - RNA, 21 nt, Homo sapiens
aaugagagaccuguacuguau

SEQ ID NO: 4777 - RNA, 22 nt, Homo sapiens
uccaguacaggucucucauuuc

SEQ ID NO: 4778 - RNA, 22 nt, Homo sapiens
ugggauccagacagugggagaa

SEQ ID NO: 4779 - RNA, 22 nt, Homo sapiens
uucucccacuaccaggcuccca

SEQ ID NO: 4780 - RNA, 22 nt, Homo sapiens
ccaaccuagguggucagaguug

SEQ ID NO: 4781 - RNA, 22 nt, Homo sapiens
aacucugaccccuuagguugau

SEQ ID NO: 4782 - RNA, 23 nt, Homo sapiens
gugccaccuuaacugcagccaau

SEQ ID NO: 4783 - RNA, 22 nt, Homo sapiens
aaguuggcugcaguuaaggugg

SEQ ID NO: 4784 - RNA, 22 nt, Homo sapiens
aagggggaaggaaacauggaga

SEQ ID NO: 4785 - RNA, 22 nt, Homo sapiens
uccauguuuccuucccccuucu

SEQ ID NO: 4786 - RNA, 21 nt, Homo sapiens
acacauggguggcuguggccu

SEQ ID NO: 4787 - RNA, 22 nt, Homo sapiens
uaggccacagccacccaugugu

SEQ ID NO: 4788 - RNA, 21 nt, Homo sapiens
agcuguaccugaaaccaagca

SEQ ID NO: 4789 - RNA, 22 nt, Homo sapiens
ucacaaaucuauaauaugcagg

SEQ ID NO: 4790 - RNA, 21 nt, Homo sapiens
ugcuuaaguuguaccaaguau

SEQ ID NO: 4791 - RNA, 22 nt, Homo sapiens
ccuggcauauuugguauaacuu

SEQ ID NO: 4792 - RNA, 22 nt, Homo sapiens
ugagggcuccaggugacggugg

SEQ ID NO: 4793 - RNA, 22 nt, Homo sapiens
accugccagcaccucccugcag

SEQ ID NO: 4794 - RNA, 23 nt, Homo sapiens
ggcaggagggcugugccagguug

SEQ ID NO: 4795 - RNA, 22 nt, Homo sapiens
cccucucuggcuccuccccaaa

SEQ ID NO: 4796 - RNA, 24 nt, Homo sapiens
ugggggagccaugagauaagagca

SEQ ID NO: 4797 - RNA, 21 nt, Homo sapiens
guaccuucugguucagcuagu

SEQ ID NO: 4798 - RNA, 23 nt, Homo sapiens
aacugaaccaggagugagcuucg

SEQ ID NO: 4799 - RNA, 22 nt, Homo sapiens
uggggaaggcgucagugucggg

SEQ ID NO: 4800 - RNA, 21 nt, Homo sapiens
agacccugcagccuucccacc

SEQ ID NO: 4801 - RNA, 22 nt, Homo sapiens
acccagguucccucuggccgca

SEQ ID NO: 4802 - RNA, 23 nt, Homo sapiens
agggccagaggagccuggagugg

SEQ ID NO: 4803 - RNA, 22 nt, Homo sapiens
auagugggaagcuggcagauuc

SEQ ID NO: 4804 - RNA, 21 nt, Homo sapiens
aucugccagcuuccacagugg

SEQ ID NO: 4805 - RNA, 25 nt, Homo sapiens
caugcugaccucccuccugccccag

SEQ ID NO: 4806 - RNA, 23 nt, Homo sapiens
ugggaggggagaggcagcaagca

SEQ ID NO: 4807 - RNA, 22 nt, Homo sapiens
ucauuuaucuguugggaagcua

SEQ ID NO: 4808 - RNA, 23 nt, Homo sapiens
cuggcggagcccauuccaugcca

SEQ ID NO: 4809 - RNA, 22 nt, Homo sapiens
cacacaaguggcccccaacacu

SEQ ID NO: 4810 - RNA, 22 nt, Homo sapiens
ugcugggggccacaugagugug

SEQ ID NO: 4811 - RNA, 21 nt, Homo sapiens
gcccugaccuguccuguucug

SEQ ID NO: 4812 - RNA, 23 nt, Homo sapiens
uguagagcagggagcaggaagcu

SEQ ID NO: 4813 - RNA, 22 nt, Homo sapiens
ccaccaggucuagcauugggau

SEQ ID NO: 4814 - RNA, 22 nt, Homo sapiens
aaucccaaugcuagacccggug

SEQ ID NO: 4815 - RNA, 22 nt, Homo sapiens
gcugcgggcugcggucagggcg

SEQ ID NO: 4816 - RNA, 21 nt, Homo sapiens
aaaggugcucaaauuagacau

SEQ ID NO: 4817 - RNA, 22 nt, Homo sapiens
ccuaauuugaacaccuucggua

SEQ ID NO: 4818 - RNA, 19 nt, Homo sapiens
aggcagguuaucugggcug

SEQ ID NO: 4819 - RNA, 20 nt, Homo sapiens
augcgaggaugcugacagug

SEQ ID NO: 4820 - RNA, 22 nt, Homo sapiens
ugaaacuggagcgccuggagga

SEQ ID NO: 4821 - RNA, 22 nt, Homo sapiens
accagcgcguuuucaguuucau

SEQ ID NO: 4822 - RNA, 25 nt, Homo sapiens
aagggaggaggagcggaggggcccu

SEQ ID NO: 4823 - RNA, 22 nt, Homo sapiens
gcccgagaggauccgucccugc

SEQ ID NO: 4824 - RNA, 22 nt, Homo sapiens
aggacugauccucucgggcagg

SEQ ID NO: 4825 - RNA, 23 nt, Homo sapiens
cgggcuguccggaggggucggcu

SEQ ID NO: 4826 - RNA, 23 nt, Homo sapiens
ucuguauucuccuuugccugcag

SEQ ID NO: 4827 - RNA, 23 nt, Homo sapiens
ucaggcaaagggauauuuacaga

SEQ ID NO: 4828 - RNA, 21 nt, Homo sapiens
uuucugucuuuucugguccag

SEQ ID NO: 4829 - RNA, 23 nt, Homo sapiens
uggccggaugggacaggaggcau

SEQ ID NO: 4830 - RNA, 23 nt, Homo sapiens
ucuaaagacuagacuucgcuaug

SEQ ID NO: 4831 - RNA, 23 nt, Homo sapiens
uggcccggcgacgucucacgguc

SEQ ID NO: 4832 - RNA, 23 nt, Homo sapiens
ugaguggggcucccgggacggcg

SEQ ID NO: 4833 - RNA, 21 nt, Homo sapiens
agcggugcuccugcgggccga

SEQ ID NO: 4834 - RNA, 23 nt, Homo sapiens
ccggucccaggagaaccugcaga

SEQ ID NO: 4835 - RNA, 22 nt, Homo sapiens
aaggcccgggcuuuccucccag

SEQ ID NO: 4836 - RNA, 22 nt, Homo sapiens
agggaaggaggcuuggucuuag

SEQ ID NO: 4837 - RNA, 21 nt, Homo sapiens
gagguuuggggaggauuugcu

SEQ ID NO: 4838 - RNA, 20 nt, Homo sapiens
cgccccuccugcccccacag

SEQ ID NO: 4839 - RNA, 22 nt, Homo sapiens
ugcggggacaggccagggcauc

SEQ ID NO: 4840 - RNA, 22 nt, Homo sapiens
ccugacccacccccucccgcag

SEQ ID NO: 4841 - RNA, 22 nt, Homo sapiens
cucgggcggaggugguugagug

SEQ ID NO: 4842 - RNA, 24 nt, Homo sapiens
agaggacccguagcugcuagaagg

SEQ ID NO: 4843 - RNA, 22 nt, Homo sapiens
uuguggaucucaaggaugugcu

SEQ ID NO: 4844 - RNA, 22 nt, Homo sapiens
uucucuuucuuuagccuugugu

SEQ ID NO: 4845 - RNA, 22 nt, Homo sapiens
caaggccaaaggaagagaacag

SEQ ID NO: 4846 - RNA, 23 nt, Homo sapiens
augcggaccuggguuagcggagu

SEQ ID NO: 4847 - RNA, 22 nt, Homo sapiens
agccaggcucugaagggaaagu

SEQ ID NO: 4848 - RNA, 22 nt, Homo sapiens
uuucccuucagagccuggcuuu

SEQ ID NO: 4849 - RNA, 22 nt, Homo sapiens
ccagagaugguugccuuccuau

SEQ ID NO: 4850 - RNA, 23 nt, Homo sapiens
cagggaggcgcucacucucugcu

SEQ ID NO: 4851 - RNA, 22 nt, Homo sapiens
caugacgucacagaggcuucgc

SEQ ID NO: 4852 - RNA, 23 nt, Homo sapiens
aggccucugugacgucacggugu

SEQ ID NO: 4853 - RNA, 23 nt, Homo sapiens
ugccccaccugcugaccacccuc

SEQ ID NO: 4854 - RNA, 23 nt, Homo sapiens
gugagugggagccgguggggcug

SEQ ID NO: 4855 - RNA, 21 nt, Homo sapiens
uaggacuagauguuggaauua

SEQ ID NO: 4856 - RNA, 22 nt, Homo sapiens
aaauucauguucaaucuaaacc

SEQ ID NO: 4857 - RNA, 22 nt, Homo sapiens
uuuagauugaacaugaaguuag

SEQ ID NO: 4858 - RNA, 21 nt, Homo sapiens
gagggcaugcgcacuuugucc

SEQ ID NO: 4859 - RNA, 21 nt, Homo sapiens
acaaggugugcaugccugacc

SEQ ID NO: 4860 - RNA, 22 nt, Homo sapiens
cuucugaucaagauuuguggug

SEQ ID NO: 4861 - RNA, 21 nt, Homo sapiens
ccaaaucuugaucagaagccu

SEQ ID NO: 4862 - RNA, 24 nt, Homo sapiens
aggcaggggcuggugcugggcggg

SEQ ID NO: 4863 - RNA, 21 nt, Homo sapiens
cgccugcccagcccuccugcu

SEQ ID NO: 4864 - RNA, 22 nt, Homo sapiens
uuaacuccuuucacacccaugg

SEQ ID NO: 4865 - RNA, 21 nt, Homo sapiens
uggauguggaaggaguuaucu

SEQ ID NO: 4866 - RNA, 22 nt, Homo sapiens
ugagugauugauagcuauguuc

SEQ ID NO: 4867 - RNA, 21 nt, Homo sapiens
auagcaauugcucuuuuggaa

SEQ ID NO: 4868 - RNA, 21 nt, Homo sapiens
ucugaaagagcaguugguguu

SEQ ID NO: 4869 - RNA, 23 nt, Homo sapiens
cgcgggcgcuccuggccgccgcc

SEQ ID NO: 4870 - RNA, 20 nt, Homo sapiens
ccaggagauccagagagaau

SEQ ID NO: 4871 - RNA, 22 nt, Homo sapiens
auucucucuggaucccauggau

SEQ ID NO: 4872 - RNA, 22 nt, Homo sapiens
ucugccauccucccuccccuac

SEQ ID NO: 4873 - RNA, 24 nt, Homo sapiens
ggugggauggagagaagguaugag

SEQ ID NO: 4874 - RNA, 18 nt, Homo sapiens
ugagaugacacuguagcu

SEQ ID NO: 4875 - RNA, 21 nt, Homo sapiens
agcagacuugaccuacaauua

SEQ ID NO: 4876 - RNA, 22 nt, Homo sapiens
ccugcaacuuugccugaucaga

SEQ ID NO: 4877 - RNA, 22 nt, Homo sapiens
ugaucaggcaaaauugcagacu

SEQ ID NO: 4878 - RNA, 22 nt, Homo sapiens
cagaacaggagcauagaaaggc

SEQ ID NO: 4879 - RNA, 21 nt, Homo sapiens
auugccuaacaugugccagaa

SEQ ID NO: 4880 - RNA, 22 nt, Homo sapiens
ucugguauguaguagguaauaa

SEQ ID NO: 4881 - RNA, 22 nt, Homo sapiens
uuaauuuuuuguuucggucacu

SEQ ID NO: 4882 - RNA, 23 nt, Homo sapiens
cuugccauccugguccacugcau

SEQ ID NO: 4883 - RNA, 22 nt, Homo sapiens
guggaccaggauggcaagggcu

SEQ ID NO: 4884 - RNA, 22 nt, Homo sapiens
auaccucaucuagaaugcugua

SEQ ID NO: 4885 - RNA, 22 nt, Homo sapiens
uucuagaugagagauauauaua

SEQ ID NO: 4886 - RNA, 22 nt, Homo sapiens
ucuucuuccuuugcagaguuga

SEQ ID NO: 4887 - RNA, 22 nt, Homo sapiens
aauucuguaaaggaagaagagg

SEQ ID NO: 4888 - RNA, 22 nt, Homo sapiens
uaggagggaauaguaaaagcag

SEQ ID NO: 4889 - RNA, 22 nt, Homo sapiens
acccuugagccugaucccuagc

SEQ ID NO: 4890 - RNA, 22 nt, Homo sapiens
aauguuggaauccucgcuagag

SEQ ID NO: 4891 - RNA, 21 nt, Homo sapiens
uagcggggauuccaauauugg

SEQ ID NO: 4892 - RNA, 22 nt, Homo sapiens
ugauugucuucauaucuagaac

SEQ ID NO: 4893 - RNA, 22 nt, Homo sapiens
uucuggauaugaagacaaucaa

SEQ ID NO: 4894 - RNA, 23 nt, Homo sapiens
ccccgguguuggggcgcgucugc

SEQ ID NO: 4895 - RNA, 21 nt, Homo sapiens
ggcgcgcccagcucccgggcu

SEQ ID NO: 4896 - RNA, 20 nt, Homo sapiens
ugaggagaugcugggacuga

SEQ ID NO: 4897 - RNA, 21 nt, Homo sapiens
agagucggcgacgccgccagc

SEQ ID NO: 4898 - RNA, 22 nt, Homo sapiens
ugaagccagcucuggucugggc

SEQ ID NO: 4899 - RNA, 22 nt, Homo sapiens
ugagaccaggacuggaugcacc

SEQ ID NO: 4900 - RNA, 24 nt, Homo sapiens
gaugcgccgcccacugccccgcgc

SEQ ID NO: 4901 - RNA, 22 nt, Homo sapiens
gcggggguggcggcggcauccc

SEQ ID NO: 4902 - RNA, 22 nt, Homo sapiens
uuacggaccagcuaagggaggc

SEQ ID NO: 4903 - RNA, 21 nt, Homo sapiens
cacacauagcagguguauaua

SEQ ID NO: 4904 - RNA, 22 nt, Homo sapiens
guauacaccugauauguguaug

SEQ ID NO: 4905 - RNA, 22 nt, Homo sapiens
ugaaugguaaagcgaugucaca

SEQ ID NO: 4906 - RNA, 20 nt, Homo sapiens
aucgcuuuaccauucauguu

SEQ ID NO: 4907 - RNA, 18 nt, Homo sapiens
uggauaugaugacugaaa

SEQ ID NO: 4908 - RNA, 18 nt, Homo sapiens
cggugagcgcucgcuggc

SEQ ID NO: 4909 - RNA, 23 nt, Homo sapiens
ucugcacugugaguuggcuggcu

SEQ ID NO: 4910 - RNA, 24 nt, Homo sapiens
acauccugcuccacagggcagagg

SEQ ID NO: 4911 - RNA, 22 nt, Homo sapiens
ucuggcuaucucacgagacugu

SEQ ID NO: 4912 - RNA, 22 nt, Homo sapiens
auauuauuagccacuucuggau

SEQ ID NO: 4913 - RNA, 21 nt, Homo sapiens
agaaguggcuaauaauauuga

SEQ ID NO: 4914 - RNA, 22 nt, Homo sapiens
uaaaguggcagaguauagacac

SEQ ID NO: 4915 - RNA, 22 nt, Homo sapiens
ugucuauacucugucacuuuac

SEQ ID NO: 4916 - RNA, 21 nt, Homo sapiens
ucucaguaaguggcacucugu

SEQ ID NO: 4917 - RNA, 21 nt, Homo sapiens
gacagagugccacuuacugaa

SEQ ID NO: 4918 - RNA, 22 nt, Homo sapiens
aacucacgaaguauaccgaagu

SEQ ID NO: 4919 - RNA, 22 nt, Homo sapiens
uucgguauacuuugugaauugg

SEQ ID NO: 4920 - RNA, 22 nt, Homo sapiens
acuggcaugcugcauuuauaua

SEQ ID NO: 4921 - RNA, 22 nt, Homo sapiens
aucuaaaugcagcaugccaguc

SEQ ID NO: 4922 - RNA, 19 nt, Homo sapiens
cauccguccgucuguccac

SEQ ID NO: 4923 - RNA, 21 nt, Homo sapiens
aguggaccgaggaaggaagga

SEQ ID NO: 4924 - RNA, 22 nt, Homo sapiens
uacacaagaaaaccaaggcuca

SEQ ID NO: 4925 - RNA, 23 nt, Homo sapiens
uacauggauggaaaccuucaagc

SEQ ID NO: 4926 - RNA, 22 nt, Homo sapiens
uauggagguucuagaccauguu

SEQ ID NO: 4927 - RNA, 21 nt, Homo sapiens
uaacauaauaguguggauuga

SEQ ID NO: 4928 - RNA, 21 nt, Homo sapiens
ugcuuaaccuugcccucgaaa

SEQ ID NO: 4929 - RNA, 21 nt, Homo sapiens
uuggacgguaagguuaagcaa

SEQ ID NO: 4930 - RNA, 21 nt, Homo sapiens
ucacuccucuccucccgucuu

SEQ ID NO: 4931 - RNA, 22 nt, Homo sapiens
aagacgggaggaaagaagggag

SEQ ID NO: 4932 - RNA, 22 nt, Homo sapiens
ucaggcucaguccccucccgau

SEQ ID NO: 4933 - RNA, 22 nt, Homo sapiens
gucauacacggcucuccucucu

SEQ ID NO: 4934 - RNA, 22 nt, Homo sapiens
agaggcuggccgugaugaauuc

SEQ ID NO: 4935 - RNA, 21 nt, Homo sapiens
cggggcagcucaguacaggau

SEQ ID NO: 4936 - RNA, 22 nt, Homo sapiens
uccuguacugagcugccccgag

SEQ ID NO: 4937 - RNA, 22 nt, Homo sapiens
aaucauacagggacauccaguu

SEQ ID NO: 4938 - RNA, 22 nt, Homo sapiens
aaucguacagggucauccacuu

SEQ ID NO: 4939 - RNA, 21 nt, Homo sapiens
uugaaaggcuauuucuugguc

SEQ ID NO: 4940 - RNA, 21 nt, Homo sapiens
cccagauaauggcacucucaa

SEQ ID NO: 4941 - RNA, 22 nt, Homo sapiens
gugacaucacauauacggcagc

SEQ ID NO: 4942 - RNA, 22 nt, Homo sapiens
caaccuggaggacuccaugcug

SEQ ID NO: 4943 - RNA, 20 nt, Homo sapiens
ccauggaucuccaggugggu

SEQ ID NO: 4944 - RNA, 22 nt, Homo sapiens
cuuaugcaagauucccuucuac

SEQ ID NO: 4945 - RNA, 22 nt, Homo sapiens
aguggggaacccuuccaugagg

SEQ ID NO: 4946 - RNA, 23 nt, Homo sapiens
aggaccugcgggacaagauucuu

SEQ ID NO: 4947 - RNA, 22 nt, Homo sapiens
ugaaggucuacugugugccagg

SEQ ID NO: 4948 - RNA, 22 nt, Homo sapiens
uuguacaugguaggcuuucauu

SEQ ID NO: 4949 - RNA, 22 nt, Homo sapiens
ugaaacauacacgggaaaccuc

SEQ ID NO: 4950 - RNA, 22 nt, Homo sapiens
aaacaaacauggugcacuucuu

SEQ ID NO: 4951 - RNA, 22 nt, Homo sapiens
gaaguugcccauguuauuuucg

SEQ ID NO: 4952 - RNA, 22 nt, Homo sapiens
ugaguauuacauggccaaucuc

SEQ ID NO: 4953 - RNA, 22 nt, Homo sapiens
caaaccacacugugguguuaga

SEQ ID NO: 4954 - RNA, 21 nt, Homo sapiens
cagcagcacacugugguuugu

SEQ ID NO: 4955 - RNA, 23 nt, Homo sapiens
uuucaagccagggggcguuuuuc

SEQ ID NO: 4956 - RNA, 20 nt, Homo sapiens
ucacuaccugacaauacagu

SEQ ID NO: 4957 - RNA, 21 nt, Homo sapiens
ugcuguauugucagguaguga

SEQ ID NO: 4958 - RNA, 22 nt, Homo sapiens
aacaucacagcaagucugugcu

SEQ ID NO: 4959 - RNA, 21 nt, Homo sapiens
uuaagacuugcagugauguuu

SEQ ID NO: 4960 - RNA, 22 nt, Homo sapiens
aacaucacugcaagucuuaaca

SEQ ID NO: 4961 - RNA, 21 nt, Homo sapiens
acagacuugcugugauguuca

SEQ ID NO: 4962 - RNA, 22 nt, Homo sapiens
ucaggacacuucugaacuugga

SEQ ID NO: 4963 - RNA, 22 nt, Homo sapiens
caguucagaaguguuccugagu

SEQ ID NO: 4964 - RNA, 22 nt, Homo sapiens
uucugccucuguccagguccuu

SEQ ID NO: 4965 - RNA, 24 nt, Homo sapiens
agggcuggacucagcggcggagcu

SEQ ID NO: 4966 - RNA, 21 nt, Homo sapiens
ugacugccucacugaccacuu

SEQ ID NO: 4967 - RNA, 24 nt, Homo sapiens
aauuugguuucugaggcacuuagu

SEQ ID NO: 4968 - RNA, 21 nt, Homo sapiens
uacuuuucuagguuguugggg

SEQ ID NO: 4969 - RNA, 23 nt, Homo sapiens
ucacaacaaccuugcaggguaga

SEQ ID NO: 4970 - RNA, 22 nt, Homo sapiens
cuuggauuuuccugggccucag

SEQ ID NO: 4971 - RNA, 22 nt, Homo sapiens
ugaggacagggcaaauucacga

SEQ ID NO: 4972 - RNA, 21 nt, Homo sapiens
uuucccuuuccauccuggcag

SEQ ID NO: 4973 - RNA, 21 nt, Homo sapiens
uugccagggcaggagguggaa

SEQ ID NO: 4974 - RNA, 22 nt, Homo sapiens
aucauaugaaccaaacucuaau

SEQ ID NO: 4975 - RNA, 22 nt, Homo sapiens
uagagucuggcugauaugguuu

SEQ ID NO: 4976 - RNA, 21 nt, Homo sapiens
ccugugcucccagggccucgc

SEQ ID NO: 4977 - RNA, 22 nt, Homo sapiens
ugaggcccuuggggcacagugg

SEQ ID NO: 4978 - RNA, 22 nt, Homo sapiens
uccuaaaucugaaaguccaaaa

SEQ ID NO: 4979 - RNA, 24 nt, Homo sapiens
uuggacuuuuucagauuuggggau

SEQ ID NO: 4980 - RNA, 22 nt, Homo sapiens
augcaccugggcaaggauucug

SEQ ID NO: 4981 - RNA, 23 nt, Homo sapiens
uaauccuugcuaccugggugaga

SEQ ID NO: 4982 - RNA, 18 nt, Homo sapiens
aauccuugcuaccugggu

SEQ ID NO: 4983 - RNA, 22 nt, Homo sapiens
uuuugugucucccauuccccag

SEQ ID NO: 4984 - RNA, 22 nt, Homo sapiens
agggggauggcagagcaaaauu

SEQ ID NO: 4985 - RNA, 22 nt, Homo sapiens
gugcauggcuguauauauaaca

SEQ ID NO: 4986 - RNA, 21 nt, Homo sapiens
uauauauacagccaugcacuc

SEQ ID NO: 4987 - RNA, 22 nt, Homo sapiens
aaugcacccgggcaaggauucu

SEQ ID NO: 4988 - RNA, 22 nt, Homo sapiens
aauccuuugucccugggugaga

SEQ ID NO: 4989 - RNA, 22 nt, Homo sapiens
aaugcaccugggcaaggauuca

SEQ ID NO: 4990 - RNA, 21 nt, Homo sapiens
auccuugcuaucugggugcua

SEQ ID NO: 4991 - RNA, 23 nt, Homo sapiens
gggguauuguuuccgcugccagg

SEQ ID NO: 4992 - RNA, 23 nt, Homo sapiens
uagcagcgggaacaguucugcag

SEQ ID NO: 4993 - RNA, 22 nt, Homo sapiens
agacccuggucugcacucuauc

SEQ ID NO: 4994 - RNA, 21 nt, Homo sapiens
uugcagcugcgguuguaaggu

SEQ ID NO: 4995 - RNA, 22 nt, Homo sapiens
cgucaacacuugcugguuuccu

SEQ ID NO: 4996 - RNA, 22 nt, Homo sapiens
gggagccaggaaguauugaugu

SEQ ID NO: 4997 - RNA, 21 nt, Homo sapiens
uaaggcacccuucugaguaga

SEQ ID NO: 4998 - RNA, 22 nt, Homo sapiens
uauucaggaagguguuacuuaa

SEQ ID NO: 4999 - RNA, 21 nt, Homo sapiens
uuuugcaccuuuuggagugaa

SEQ ID NO: 5000 - RNA, 23 nt, Homo sapiens
ugauuguagccuuuuggaguaga

SEQ ID NO: 5001 - RNA, 23 nt, Homo sapiens
uacuccagagggcgucacucaug

SEQ ID NO: 5002 - RNA, 23 nt, Homo sapiens
ggguuuguagcuuugcuggcaug

SEQ ID NO: 5003 - RNA, 23 nt, Homo sapiens
cagggcucagggauuggauggag

SEQ ID NO: 5004 - RNA, 23 nt, Homo sapiens
augcuacucggaaaucccacuga

SEQ ID NO: 5005 - RNA, 21 nt, Homo sapiens
gugggauuucugaguagcauc

SEQ ID NO: 5006 - RNA, 23 nt, Homo sapiens
ccggggcagauugguguagggug

SEQ ID NO: 5007 - RNA, 23 nt, Homo sapiens
acggagacgacaagacugugcug

SEQ ID NO: 5008 - RNA, 22 nt, Homo sapiens
aauccacgcugagcuuggcauc

SEQ ID NO: 5009 - RNA, 23 nt, Homo sapiens
aggaaaugaggcuggcuaggagc

SEQ ID NO: 5010 - RNA, 22 nt, Homo sapiens
uacugcagacguggcaaucaug

SEQ ID NO: 5011 - RNA, 22 nt, Homo sapiens
ugauugguacgucuguggguag

SEQ ID NO: 5012 - RNA, 22 nt, Homo sapiens
aaucagugaaugccuugaaccu

SEQ ID NO: 5013 - RNA, 21 nt, Homo sapiens
uuacaggcgugaaccaccgcg

SEQ ID NO: 5014 - RNA, 21 nt, Homo sapiens
uacugcagacaguggcaauca

SEQ ID NO: 5015 - RNA, 21 nt, Homo sapiens
guuucaccauguuggucaggc

SEQ ID NO: 5016 - RNA, 22 nt, Homo sapiens
uacucaggagaguggcaaucac

SEQ ID NO: 5017 - RNA, 22 nt, Homo sapiens
uucagaucccagcggugccucu

SEQ ID NO: 5018 - RNA, 21 nt, Homo sapiens
gugucuuuugcucugcaguca

SEQ ID NO: 5019 - RNA, 22 nt, Homo sapiens
aagugcugucauagcugagguc

SEQ ID NO: 5020 - RNA, 23 nt, Homo sapiens
cacucagccuugagggcacuuuc

SEQ ID NO: 5021 - RNA, 23 nt, Homo sapiens
uaaauuucaccuuucugagaagg

SEQ ID NO: 5022 - RNA, 18 nt, Homo sapiens
uucacagggaggugucau

SEQ ID NO: 5023 - RNA, 22 nt, Homo sapiens
uucacaaggaggugucauuuau

SEQ ID NO: 5024 - RNA, 23 nt, Homo sapiens
uaaauuucaccuuucugagaaga

SEQ ID NO: 5025 - RNA, 22 nt, Homo sapiens
uucucaaggaggugucguuuau

SEQ ID NO: 5026 - RNA, 21 nt, Homo sapiens
auugacacuucugugaguaga

SEQ ID NO: 5027 - RNA, 23 nt, Homo sapiens
uacucuggagagugacaaucaug

SEQ ID NO: 5028 - RNA, 21 nt, Homo sapiens
auugacaccucugugagugga

SEQ ID NO: 5029 - RNA, 22 nt, Homo sapiens
uucucaagagggaggcaaucau

SEQ ID NO: 5030 - RNA, 22 nt, Homo sapiens
gagugccuucuuuuggagcguu

SEQ ID NO: 5031 - RNA, 24 nt, Homo sapiens
uucuccaaaagaaagcacuuucug

SEQ ID NO: 5032 - RNA, 18 nt, Homo sapiens
ugcuuccuuucagagggu

SEQ ID NO: 5033 - RNA, 23 nt, Homo sapiens
uucucgaggaaagaagcacuuuc

SEQ ID NO: 5034 - RNA, 18 nt, Homo sapiens
ugcuuccuuucagagggu

SEQ ID NO: 5035 - RNA, 22 nt, Homo sapiens
aucuggagguaagaagcacuuu

SEQ ID NO: 5036 - RNA, 22 nt, Homo sapiens
ccucuagauggaagcacugucu

SEQ ID NO: 5037 - RNA, 22 nt, Homo sapiens
aucgugcaucccuuuagagugu

SEQ ID NO: 5038 - RNA, 22 nt, Homo sapiens
aucgugcaucccuuuagagugu

SEQ ID NO: 5039 - RNA, 22 nt, Homo sapiens
aucgugcauccuuuuagagugu

SEQ ID NO: 5040 - RNA, 21 nt, Homo sapiens
agagauugguagaaaucaggu

SEQ ID NO: 5041 - RNA, 21 nt, Homo sapiens
acugaauccucuuuuccucag

SEQ ID NO: 5042 - RNA, 22 nt, Homo sapiens
ugggaugagggauugaagugga

SEQ ID NO: 5043 - RNA, 23 nt, Homo sapiens
aaucggacccauuuaaaccggag

SEQ ID NO: 5044 - RNA, 24 nt, Homo sapiens
ucugggcacaggcggauggacagg

SEQ ID NO: 5045 - RNA, 22 nt, Homo sapiens
gaaagcgcuucccuuugcugga

SEQ ID NO: 5046 - RNA, 20 nt, Homo sapiens
cugcaaagggaagcccuuuc

SEQ ID NO: 5047 - RNA, 22 nt, Homo sapiens
caaagcgcuccccuuuagaggu

SEQ ID NO: 5048 - RNA, 23 nt, Homo sapiens
caaagcgcuucucuuuagagugu

SEQ ID NO: 5049 - RNA, 23 nt, Homo sapiens
ucucuggagggaagcacuuucug

SEQ ID NO: 5050 - RNA, 21 nt, Homo sapiens
caaagcgcuucccuuuggagc

SEQ ID NO: 5051 - RNA, 22 nt, Homo sapiens
cucuagagggaagcacuuucug

SEQ ID NO: 5052 - RNA, 21 nt, Homo sapiens
aaagcgcuucccuucagagug

SEQ ID NO: 5053 - RNA, 22 nt, Homo sapiens
cucuagagggaagcgcuuucug

SEQ ID NO: 5054 - RNA, 21 nt, Homo sapiens
gaaagcgcuucucuuuagagg

SEQ ID NO: 5055 - RNA, 22 nt, Homo sapiens
cucuagagggaagcacuuucuc

SEQ ID NO: 5056 - RNA, 21 nt, Homo sapiens
ccagugacugagcuggagcca

SEQ ID NO: 5057 - RNA, 22 nt, Homo sapiens
aggauaggaagaaugaagugcu

SEQ ID NO: 5058 - RNA, 22 nt, Homo sapiens
aggagaguggauuccagguggu

SEQ ID NO: 5059 - RNA, 22 nt, Homo sapiens
uccuccucuaccucaucccagu

SEQ ID NO: 5060 - RNA, 22 nt, Homo sapiens
ugagggguuuggaaugggaugg

SEQ ID NO: 5061 - RNA, 21 nt, Homo sapiens
auccaguucucugagggggcu

SEQ ID NO: 5062 - RNA, 22 nt, Homo sapiens
aaccccuaaggcaacuggaugg

SEQ ID NO: 5063 - RNA, 21 nt, Homo sapiens
ucauccucgucucccucccag

SEQ ID NO: 5064 - RNA, 22 nt, Homo sapiens
agggaaggggacgaggguuggg

SEQ ID NO: 5065 - RNA, 23 nt, Homo sapiens
aagaagagacugagucaucgaau

SEQ ID NO: 5066 - RNA, 23 nt, Homo sapiens
caauggcacaaacucauucuuga

SEQ ID NO: 5067 - RNA, 22 nt, Homo sapiens
aaagugcauccuuuuagagugu

SEQ ID NO: 5068 - RNA, 22 nt, Homo sapiens
cucuagagggaagcgcuuucug

SEQ ID NO: 5069 - RNA, 22 nt, Homo sapiens
aaagugcauccuuuuagagguu

SEQ ID NO: 5070 - RNA, 22 nt, Homo sapiens
cucuagagggaagcgcuuucug

SEQ ID NO: 5071 - RNA, 22 nt, Homo sapiens
aaagugcaucuuuuuagaggau

SEQ ID NO: 5072 - RNA, 22 nt, Homo sapiens
cucuagagggaagcgcuuucug

SEQ ID NO: 5073 - RNA, 22 nt, Homo sapiens
caaagugccucccuuuagagug

SEQ ID NO: 5074 - RNA, 22 nt, Homo sapiens
aagugccuccuuuuagaguguu

SEQ ID NO: 5075 - RNA, 22 nt, Homo sapiens
uucuccaaaagggagcacuuuc

SEQ ID NO: 5076 - RNA, 22 nt, Homo sapiens
aaagugcuucccuuuggacugu

SEQ ID NO: 5077 - RNA, 21 nt, Homo sapiens
cuccagagggaaguacuuucu

SEQ ID NO: 5078 - RNA, 21 nt, Homo sapiens
aaagugcuuccuuuuagaggg

SEQ ID NO: 5079 - RNA, 22 nt, Homo sapiens
aaagugcuuccuuuuagagggu

SEQ ID NO: 5080 - RNA, 22 nt, Homo sapiens
cucuagagggaagcacuuucug

SEQ ID NO: 5081 - RNA, 22 nt, Homo sapiens
aaagugcuucucuuuggugggu

SEQ ID NO: 5082 - RNA, 20 nt, Homo sapiens
cuacaaagggaagcccuuuc

SEQ ID NO: 5083 - RNA, 21 nt, Homo sapiens
aaagugcuuccuuuuugaggg

SEQ ID NO: 5084 - RNA, 22 nt, Homo sapiens
aagugcuuccuuuuagaggguu

SEQ ID NO: 5085 - RNA, 24 nt, Homo sapiens
acaaagugcuucccuuuagagugu

SEQ ID NO: 5086 - RNA, 22 nt, Homo sapiens
acaaagugcuucccuuuagagu

SEQ ID NO: 5087 - RNA, 22 nt, Homo sapiens
aacgcacuucccuuuagagugu

SEQ ID NO: 5088 - RNA, 22 nt, Homo sapiens
aaaaugguucccuuuagagugu

SEQ ID NO: 5089 - RNA, 22 nt, Homo sapiens
cucuagagggaagcgcuuucug

SEQ ID NO: 5090 - RNA, 23 nt, Homo sapiens
gaacgcgcuucccuauagagggu

SEQ ID NO: 5091 - RNA, 22 nt, Homo sapiens
cucuagagggaagcgcuuucug

SEQ ID NO: 5092 - RNA, 21 nt, Homo sapiens
gaaggcgcuucccuuuggagu

SEQ ID NO: 5093 - RNA, 22 nt, Homo sapiens
cuacaaagggaagcacuuucuc

SEQ ID NO: 5094 - RNA, 22 nt, Homo sapiens
gaaggcgcuucccuuuagagcg

SEQ ID NO: 5095 - RNA, 21 nt, Homo sapiens
cuccagagggaugcacuuucu

SEQ ID NO: 5096 - RNA, 22 nt, Homo sapiens
cucuagagggaagcacuuucug

SEQ ID NO: 5097 - RNA, 22 nt, Homo sapiens
gaaagugcuuccuuuuagaggc

SEQ ID NO: 5098 - RNA, 23 nt, Homo sapiens
cucuugagggaagcacuuucugu

SEQ ID NO: 5099 - RNA, 20 nt, Homo sapiens
cugcaaagggaagcccuuuc

SEQ ID NO: 5100 - RNA, 22 nt, Homo sapiens
ccucccacacccaaggcuugca

SEQ ID NO: 5101 - RNA, 22 nt, Homo sapiens
caugccuugaguguaggaccgu

SEQ ID NO: 5102 - RNA, 22 nt, Homo sapiens
aucauacaaggacaauuucuuu

SEQ ID NO: 5103 - RNA, 22 nt, Homo sapiens
ggagaaauuauccuuggugugu

SEQ ID NO: 5104 - RNA, 22 nt, Homo sapiens
uggugggcacagaaucuggacu

SEQ ID NO: 5105 - RNA, 25 nt, Homo sapiens
aaaggauucugcugucggucccacu

SEQ ID NO: 5106 - RNA, 22 nt, Homo sapiens
ugugacagauugauaacugaaa

SEQ ID NO: 5107 - RNA, 23 nt, Homo sapiens
ucggggaucaucaugucacgaga

SEQ ID NO: 5108 - RNA, 22 nt, Homo sapiens
aaacauucgcggugcacuucuu

SEQ ID NO: 5109 - RNA, 22 nt, Homo sapiens
auucugcauuuuuagcaaguuc

SEQ ID NO: 5110 - RNA, 22 nt, Homo sapiens
accugagguugugcauuucuaa

SEQ ID NO: 5111 - RNA, 22 nt, Homo sapiens
ucagcaaacauuuauugugugc

SEQ ID NO: 5112 - RNA, 22 nt, Homo sapiens
ucaguaaauguuuauuagauga

SEQ ID NO: 5113 - RNA, 22 nt, Homo sapiens
agcuacaguuacuuuugcacca

SEQ ID NO: 5114 - RNA, 20 nt, Homo sapiens
uaaaaacugcaauuacuuuc

SEQ ID NO: 5115 - RNA, 23 nt, Homo sapiens
ugcaaaaguaauugcaguuuuug

SEQ ID NO: 5116 - RNA, 22 nt, Homo sapiens
agaaguaauugcgguuuugcca

SEQ ID NO: 5117 - RNA, 22 nt, Homo sapiens
caaaacuggcaauuacuuuugc

SEQ ID NO: 5118 - RNA, 22 nt, Homo sapiens
aaaaguaauugcgaguuuuacc

SEQ ID NO: 5119 - RNA, 25 nt, Homo sapiens
aaaaaccacaauuacuuuugcacca

SEQ ID NO: 5120 - RNA, 22 nt, Homo sapiens
aaaaguaauuguggauuuugcu

SEQ ID NO: 5121 - RNA, 22 nt, Homo sapiens
caaaaaccggcaauuacuuuug

SEQ ID NO: 5122 - RNA, 22 nt, Homo sapiens
gaaaacgacaaugacuuuugca

SEQ ID NO: 5123 - RNA, 21 nt, Homo sapiens
caaaaacugcaauuacuuuca

SEQ ID NO: 5124 - RNA, 21 nt, Homo sapiens
aaagguaauugugguuucugc

SEQ ID NO: 5125 - RNA, 22 nt, Homo sapiens
caaaaacugcaguuacuuuugc

SEQ ID NO: 5126 - RNA, 20 nt, Homo sapiens
aaaagugauugcaguguuug

SEQ ID NO: 5127 - RNA, 22 nt, Homo sapiens
aaagguaauugcaguuuuuccc

SEQ ID NO: 5128 - RNA, 21 nt, Homo sapiens
uaaaaacugcaauuacuuuua

SEQ ID NO: 5129 - RNA, 23 nt, Homo sapiens
ugcaaaaguaauugcaguuuuug

SEQ ID NO: 5130 - RNA, 21 nt, Homo sapiens
aaaaguaacugcgguuuuuga

SEQ ID NO: 5131 - RNA, 22 nt, Homo sapiens
aacggcaaugacuuuuguacca

SEQ ID NO: 5132 - RNA, 22 nt, Homo sapiens
caaaaacugcaguuacuuuugu

SEQ ID NO: 5133 - RNA, 22 nt, Homo sapiens
aaaaguaauugcgguuuuugcc

SEQ ID NO: 5134 - RNA, 20 nt, Homo sapiens
aaaaggcauugugguuuuug

SEQ ID NO: 5135 - RNA, 22 nt, Homo sapiens
aaagaccgugacuacuuuugca

SEQ ID NO: 5136 - RNA, 22 nt, Homo sapiens
agaaguaacuacgguuuuugca

SEQ ID NO: 5137 - RNA, 19 nt, Homo sapiens
aaaaaccacaauuacuuuu

SEQ ID NO: 5138 - RNA, 19 nt, Homo sapiens
aaaaguaauugcggucuuu

SEQ ID NO: 5139 - RNA, 22 nt, Homo sapiens
caaaaacugcaauuacuuuugc

SEQ ID NO: 5140 - RNA, 22 nt, Homo sapiens
gaaaguaauugcuguuuuugcc

SEQ ID NO: 5141 - RNA, 21 nt, Homo sapiens
uaaaacugcaguuauuuuugc

SEQ ID NO: 5142 - RNA, 21 nt, Homo sapiens
aaaaguaauugcaguuuuugc

SEQ ID NO: 5143 - RNA, 22 nt, Homo sapiens
uaaaacccacaauuauguuugu

SEQ ID NO: 5144 - RNA, 22 nt, Homo sapiens
aaaaguaauugcggguuuugcc

SEQ ID NO: 5145 - RNA, 21 nt, Homo sapiens
caaaaccgcaguaacuuuugu

SEQ ID NO: 5146 - RNA, 22 nt, Homo sapiens
aaaaguuauugcgguuuuggcu

SEQ ID NO: 5147 - RNA, 21 nt, Homo sapiens
uggcaguuacuuuugcaccag

SEQ ID NO: 5148 - RNA, 21 nt, Homo sapiens
aaaaguaauugcgguuuuugc

SEQ ID NO: 5149 - RNA, 20 nt, Homo sapiens
aaaacugcaguuacuuuugc

SEQ ID NO: 5150 - RNA, 18 nt, Homo sapiens
aaaaguacuugcggauuu

SEQ ID NO: 5151 - RNA, 20 nt, Homo sapiens
gugcaaaagucaucacgguu

SEQ ID NO: 5152 - RNA, 22 nt, Homo sapiens
caaaaccgcgauuacucuugca

SEQ ID NO: 5153 - RNA, 21 nt, Homo sapiens
aaaaguaauugugguuuuugc

SEQ ID NO: 5154 - RNA, 21 nt, Homo sapiens
aaaaacugcaaucacuuuugc

SEQ ID NO: 5155 - RNA, 22 nt, Homo sapiens
caaaagugauugugguuuuugc

SEQ ID NO: 5156 - RNA, 22 nt, Homo sapiens
caagaaccucaguugcuuuugu

SEQ ID NO: 5157 - RNA, 22 nt, Homo sapiens
aaaaguaauugugguuuuggcc

SEQ ID NO: 5158 - RNA, 22 nt, Homo sapiens
caaaaaucucaauuacuuuugc

SEQ ID NO: 5159 - RNA, 22 nt, Homo sapiens
aaaaguaauugcgguuuuugcc

SEQ ID NO: 5160 - RNA, 22 nt, Homo sapiens
caaaaaccacaguuucuuuugc

SEQ ID NO: 5161 - RNA, 22 nt, Homo sapiens
aaaaguaauugugguuuuugcc

SEQ ID NO: 5162 - RNA, 22 nt, Homo sapiens
aaaaacugagacuacuuuugca

SEQ ID NO: 5163 - RNA, 19 nt, Homo sapiens
aaaaacuguaauuacuuuu

SEQ ID NO: 5164 - RNA, 22 nt, Homo sapiens
aaaacuguaauuacuuuuguac

SEQ ID NO: 5165 - RNA, 23 nt, Homo sapiens
ugcaaaaguaauugcaguuuuug

SEQ ID NO: 5166 - RNA, 23 nt, Homo sapiens
caaaaaccgcaauuacuuuugca

SEQ ID NO: 5167 - RNA, 22 nt, Homo sapiens
aaaaguaaucgcgguuuuuguc

SEQ ID NO: 5168 - RNA, 22 nt, Homo sapiens
aaaaguaauugcggauuuugcc

SEQ ID NO: 5169 - RNA, 22 nt, Homo sapiens
aaaaguaauugcggucuuuggu

SEQ ID NO: 5170 - RNA, 22 nt, Homo sapiens
aaaaguacuugcggauuuugcu

SEQ ID NO: 5171 - RNA, 22 nt, Homo sapiens
aaaaguauuugcggguuuuguc

SEQ ID NO: 5172 - RNA, 21 nt, Homo sapiens
caaagguauuugugguuuuug

SEQ ID NO: 5173 - RNA, 22 nt, Homo sapiens
caaaaguaauuguggauuuugu

SEQ ID NO: 5174 - RNA, 22 nt, Homo sapiens
ccaaaacugcaguuacuuuugc

SEQ ID NO: 5175 - RNA, 22 nt, Homo sapiens
aaaaguaauugcgguuuuugcc

SEQ ID NO: 5176 - RNA, 22 nt, Homo sapiens
uagcaaaaacugcaguuacuuu

SEQ ID NO: 5177 - RNA, 22 nt, Homo sapiens
gcuggugcaaaaguaauggcgg

SEQ ID NO: 5178 - RNA, 23 nt, Homo sapiens
auggccaaaacugcaguuauuuu

SEQ ID NO: 5179 - RNA, 25 nt, Homo sapiens
aaaaaccacaauuacuuuugcacca

SEQ ID NO: 5180 - RNA, 21 nt, Homo sapiens
caaaagugaucgugguuuuug

SEQ ID NO: 5181 - RNA, 23 nt, Homo sapiens
caaagacugcaauuacuuuugcg

SEQ ID NO: 5182 - RNA, 23 nt, Homo sapiens
aaaaguaacugcgguuuuugccu

SEQ ID NO: 5183 - RNA, 22 nt, Homo sapiens
aaaaguaaucacuguuuuugcc

SEQ ID NO: 5184 - RNA, 23 nt, Homo sapiens
caaaaaccgcaauuacuuuugca

SEQ ID NO: 5185 - RNA, 21 nt, Homo sapiens
ugacaacuauggaugagcucu

SEQ ID NO: 5186 - RNA, 20 nt, Homo sapiens
agugccugagggaguaagag

SEQ ID NO: 5187 - RNA, 22 nt, Homo sapiens
ugucuuacucccucaggcacau

SEQ ID NO: 5188 - RNA, 23 nt, Homo sapiens
agugccugagggaguaagagccc

SEQ ID NO: 5189 - RNA, 22 nt, Homo sapiens
augugccugagggaguaagaca

SEQ ID NO: 5190 - RNA, 20 nt, Homo sapiens
ucuuacucccucaggcacug

SEQ ID NO: 5191 - RNA, 21 nt, Homo sapiens
gcgacccacucuugguuucca

SEQ ID NO: 5192 - RNA, 21 nt, Homo sapiens
gcgacccauacuugguuucag

SEQ ID NO: 5193 - RNA, 22 nt, Homo sapiens
gaaaucaagcgugggugagacc

SEQ ID NO: 5194 - RNA, 21 nt, Homo sapiens
aacaggugacugguuagacaa

SEQ ID NO: 5195 - RNA, 21 nt, Homo sapiens
aaaacggugagauuuuguuuu

SEQ ID NO: 5196 - RNA, 21 nt, Homo sapiens
gcuaguccugacucagccagu

SEQ ID NO: 5197 - RNA, 21 nt, Homo sapiens
aggguaagcugaaccucugau

SEQ ID NO: 5198 - RNA, 22 nt, Homo sapiens
auauuaccauuagcucaucuuu

SEQ ID NO: 5199 - RNA, 22 nt, Homo sapiens
gaugagcucauuguaauaugag

SEQ ID NO: 5200 - RNA, 23 nt, Homo sapiens
guuugcacgggugggccuugucu

SEQ ID NO: 5201 - RNA, 19 nt, Homo sapiens
guccuaggaggcuccucug

SEQ ID NO: 5202 - RNA, 21 nt, Homo sapiens
caauucucaaaggagccuccc

SEQ ID NO: 5203 - RNA, 21 nt, Homo sapiens
guuggggugcaggggucugcu

SEQ ID NO: 5204 - RNA, 22 nt, Homo sapiens
uuagcuuaaggaguaccagauc

SEQ ID NO: 5205 - RNA, 21 nt, Homo sapiens
uaugguacuccuuaagcuaac

SEQ ID NO: 5206 - RNA, 19 nt, Homo sapiens
ugagcugcuguaccaaaau

SEQ ID NO: 5207 - RNA, 22 nt, Homo sapiens
cacauaugaagugagccagcac

SEQ ID NO: 5208 - RNA, 22 nt, Homo sapiens
ugcuggcucauuucauaugugu

SEQ ID NO: 5209 - RNA, 22 nt, Homo sapiens
uuccaugccuccuagaaguucc

SEQ ID NO: 5210 - RNA, 22 nt, Homo sapiens
agccuuccaggagaaauggaga

SEQ ID NO: 5211 - RNA, 22 nt, Homo sapiens
uaaaacuuuaagugugccuagg

SEQ ID NO: 5212 - RNA, 22 nt, Homo sapiens
uaggcacacuuaaaguuauagc

SEQ ID NO: 5213 - RNA, 22 nt, Homo sapiens
gaauauggguauauuaguuugg

SEQ ID NO: 5214 - RNA, 22 nt, Homo sapiens
aaacuaauauacccauauucug

SEQ ID NO: 5215 - RNA, 22 nt, Homo sapiens
uaguucuucccuuugcccaauu

SEQ ID NO: 5216 - RNA, 22 nt, Homo sapiens
cagggaaaugggaagaacuaga

SEQ ID NO: 5217 - RNA, 22 nt, Homo sapiens
cugaauagcugggacuacaggu

SEQ ID NO: 5218 - RNA, 22 nt, Homo sapiens
ugaaguaccagcuacucgagag

SEQ ID NO: 5219 - RNA, 22 nt, Homo sapiens
cagagugacaagcugguuaaag

SEQ ID NO: 5220 - RNA, 22 nt, Homo sapiens
uauccagcuuguuacuauaugc

SEQ ID NO: 5221 - RNA, 21 nt, Homo sapiens
gccccgggcagugugaucauc

SEQ ID NO: 5222 - RNA, 18 nt, Homo sapiens
auggucaccuccgggacu

SEQ ID NO: 5223 - RNA, 19 nt, Homo sapiens
aagucccacuaaugccagc

SEQ ID NO: 5224 - RNA, 21 nt, Homo sapiens
acuggcauuagugggacuuuu

SEQ ID NO: 5225 - RNA, 23 nt, Homo sapiens
ugcacauggcaaccuagcuccca

SEQ ID NO: 5226 - RNA, 21 nt, Homo sapiens
ggcugggugcucuugugcagu

SEQ ID NO: 5227 - RNA, 21 nt, Homo sapiens
uaaaguaaauaugcaccaaaa

SEQ ID NO: 5228 - RNA, 21 nt, Homo sapiens
aauaaaguucauguauggcaa

SEQ ID NO: 5229 - RNA, 21 nt, Homo sapiens
uugccauacauagacuuuauu

SEQ ID NO: 5230 - RNA, 21 nt, Homo sapiens
auacccauagcuuagcuccca

SEQ ID NO: 5231 - RNA, 21 nt, Homo sapiens
ugggagcuaagcuauggguau

SEQ ID NO: 5232 - RNA, 22 nt, Homo sapiens
caaaguuuaagauccuugaagu

SEQ ID NO: 5233 - RNA, 22 nt, Homo sapiens
aucaaggaucuuaaacuuugcc

SEQ ID NO: 5234 - RNA, 20 nt, Homo sapiens
aaaguagcuguaccauuugc

SEQ ID NO: 5235 - RNA, 19 nt, Homo sapiens
agguugacauacguuuccc

SEQ ID NO: 5236 - RNA, 19 nt, Homo sapiens
aggcacggugucagcaggc

SEQ ID NO: 5237 - RNA, 19 nt, Homo sapiens
gggcgccugugaucccaac

SEQ ID NO: 5238 - RNA, 23 nt, Homo sapiens
aguauguucuuccaggacagaac

SEQ ID NO: 5239 - RNA, 20 nt, Homo sapiens
auguauaaauguauacacac

SEQ ID NO: 5240 - RNA, 22 nt, Homo sapiens
gagaaaugcuggacuaaucugc

SEQ ID NO: 5241 - RNA, 22 nt, Homo sapiens
agaaaggguggcaauaccucuu

SEQ ID NO: 5242 - RNA, 22 nt, Homo sapiens
agguauugccacccuuucuagu

SEQ ID NO: 5243 - RNA, 22 nt, Homo sapiens
guagcaccuugcaggauaaggu

SEQ ID NO: 5244 - RNA, 24 nt, Homo sapiens
uacagaugcagauucucugacuuc

SEQ ID NO: 5245 - RNA, 20 nt, Homo sapiens
aacucuagccugagcaacag

SEQ ID NO: 5246 - RNA, 22 nt, Homo sapiens
acagcccagcaguuaucacggg

SEQ ID NO: 5247 - RNA, 21 nt, Homo sapiens
uaucguaucguauuguauugu

SEQ ID NO: 5248 - RNA, 22 nt, Homo sapiens
uuagaacguuuuagggucaaau

SEQ ID NO: 5249 - RNA, 22 nt, Homo sapiens
uaacaaacaccuguaaaacagc

SEQ ID NO: 5250 - RNA, 22 nt, Homo sapiens
agcauacaccuguaguccuaga

SEQ ID NO: 5251 - RNA, 21 nt, Homo sapiens
aguuaaugaauccuggaaagu

SEQ ID NO: 5252 - RNA, 21 nt, Homo sapiens
ucagcuacuaccucuauuagg

SEQ ID NO: 5253 - RNA, 22 nt, Homo sapiens
uugcucugagcuccgagaaagc

SEQ ID NO: 5254 - RNA, 22 nt, Homo sapiens
caaauaauaccacagugggugu

SEQ ID NO: 5255 - RNA, 20 nt, Homo sapiens
aauaauaucacaguaggugu

SEQ ID NO: 5256 - RNA, 22 nt, Homo sapiens
aauaauaucacaguagguguac

SEQ ID NO: 5257 - RNA, 22 nt, Homo sapiens
gcaguggcucugaaaugaacuc

SEQ ID NO: 5258 - RNA, 21 nt, Homo sapiens
cagaucaugggacugucucag

SEQ ID NO: 5259 - RNA, 22 nt, Homo sapiens
acuccaagaagaaucuagacag

SEQ ID NO: 5260 - RNA, 22 nt, Homo sapiens
cucauuuaaguagucugaugcc

SEQ ID NO: 5261 - RNA, 22 nt, Homo sapiens
ucaaguaguuucaugauaaagg

SEQ ID NO: 5262 - RNA, 22 nt, Homo sapiens
ugggggagugcagugauugugg

SEQ ID NO: 5263 - RNA, 22 nt, Homo sapiens
uccugucuuuccuuguuggagc

SEQ ID NO: 5264 - RNA, 22 nt, Homo sapiens
uaaugcauuaaauuauugaagg

SEQ ID NO: 5265 - RNA, 19 nt, Homo sapiens
uuauugucacguucugauu

SEQ ID NO: 5266 - RNA, 22 nt, Homo sapiens
ugagucagcaacauaucccaug

SEQ ID NO: 5267 - RNA, 18 nt, Homo sapiens
aggagaagucgggaaggu

SEQ ID NO: 5268 - RNA, 22 nt, Homo sapiens
cgaaaacagcaauuaccuuugc

SEQ ID NO: 5269 - RNA, 22 nt, Homo sapiens
uuaggccaucaucccauuaugc

SEQ ID NO: 5270 - RNA, 23 nt, Homo sapiens
uguuucggggcucauggccugug

SEQ ID NO: 5271 - RNA, 22 nt, Homo sapiens
aaagguaauugcaguuuuuccc

SEQ ID NO: 5272 - RNA, 22 nt, Homo sapiens
uucuggauaacaugcugaagcu

SEQ ID NO: 5273 - RNA, 22 nt, Homo sapiens
acguuugaaugcuguacaaggc

SEQ ID NO: 5274 - RNA, 20 nt, Homo sapiens
augagcgacugugccugacc

SEQ ID NO: 5275 - RNA, 21 nt, Homo sapiens
ugaguuggccaucugagugag

SEQ ID NO: 5276 - RNA, 20 nt, Homo sapiens
guccgcucggcgguggccca

SEQ ID NO: 5277 - RNA, 24 nt, Homo sapiens
cugaagugauguguaacugaucag

SEQ ID NO: 5278 - RNA, 20 nt, Homo sapiens
gcggagagagaauggggagc

SEQ ID NO: 5279 - RNA, 22 nt, Homo sapiens
cacgcucaugcacacacccaca

SEQ ID NO: 5280 - RNA, 23 nt, Homo sapiens
ugagugugugugugugagugugu

SEQ ID NO: 5281 - RNA, 19 nt, Homo sapiens
gagccaguuggacaggagc

SEQ ID NO: 5282 - RNA, 22 nt, Homo sapiens
aagauguggaaaaauuggaauc

SEQ ID NO: 5283 - RNA, 22 nt, Homo sapiens
auucuaauuucuccacgucuuu

SEQ ID NO: 5284 - RNA, 21 nt, Homo sapiens
uagauaaaauauugguaccug

SEQ ID NO: 5285 - RNA, 21 nt, Homo sapiens
cuucuugugcucuaggauugu

SEQ ID NO: 5286 - RNA, 20 nt, Homo sapiens
gggcuggggcgcggggaggu

SEQ ID NO: 5287 - RNA, 23 nt, Homo sapiens
uucauuugguauaaaccgcgauu

SEQ ID NO: 5288 - RNA, 22 nt, Homo sapiens
uugagaaugaugaaucauuagg

SEQ ID NO: 5289 - RNA, 21 nt, Homo sapiens
ucuuguguucucuagaucagu

SEQ ID NO: 5290 - RNA, 22 nt, Homo sapiens
uaacugguugaacaacugaacc

SEQ ID NO: 5291 - RNA, 23 nt, Homo sapiens
uuacaguuguucaaccaguuacu

SEQ ID NO: 5292 - RNA, 21 nt, Homo sapiens
caaagaggaaggucccauuac

SEQ ID NO: 5293 - RNA, 22 nt, Homo sapiens
ucaguuccaggccaaccaggcu

SEQ ID NO: 5294 - RNA, 22 nt, Homo sapiens
uuaugguuugccugggacugag

SEQ ID NO: 5295 - RNA, 19 nt, Homo sapiens
ugggcguaucuguaugcua

SEQ ID NO: 5296 - RNA, 22 nt, Homo sapiens
uaugcauuguauuuuuaggucc

SEQ ID NO: 5297 - RNA, 21 nt, Homo sapiens
uuuccauaggugaugagucac

SEQ ID NO: 5298 - RNA, 21 nt, Homo sapiens
uuggccacaauggguuagaac

SEQ ID NO: 5299 - RNA, 24 nt, Homo sapiens
ucagaacaaaugccgguucccaga

SEQ ID NO: 5300 - RNA, 22 nt, Homo sapiens
ugagaaccacgucugcucugag

SEQ ID NO: 5301 - RNA, 21 nt, Homo sapiens
uaauuuuauguauaagcuagu

SEQ ID NO: 5302 - RNA, 22 nt, Homo sapiens
gagcuuauucauaaaagugcag

SEQ ID NO: 5303 - RNA, 20 nt, Homo sapiens
agaccauggguucucauugu

SEQ ID NO: 5304 - RNA, 22 nt, Homo sapiens
uugugucaauaugcgaugaugu

SEQ ID NO: 5305 - RNA, 19 nt, Homo sapiens
ugucucugcugggguuucu

SEQ ID NO: 5306 - RNA, 25 nt, Homo sapiens
aggcaccagccaggcauugcucagc

SEQ ID NO: 5307 - RNA, 21 nt, Homo sapiens
gaagugugccguggugugucu

SEQ ID NO: 5308 - RNA, 21 nt, Homo sapiens
aagccugcccggcuccucggg

SEQ ID NO: 5309 - RNA, 22 nt, Homo sapiens
ugugucacucgaugaccacugu

SEQ ID NO: 5310 - RNA, 22 nt, Homo sapiens
uacgucaucguugucaucguca

SEQ ID NO: 5311 - RNA, 20 nt, Homo sapiens
guugugucaguuuaucaaac

SEQ ID NO: 5312 - RNA, 23 nt, Homo sapiens
acuuacagacaagagccuugcuc

SEQ ID NO: 5313 - RNA, 22 nt, Homo sapiens
uggucuaggauuguuggaggag

SEQ ID NO: 5314 - RNA, 23 nt, Homo sapiens
gacacgggcgacagcugcggccc

SEQ ID NO: 5315 - RNA, 22 nt, Homo sapiens
cacacacugcaauuacuuuugc

SEQ ID NO: 5316 - RNA, 19 nt, Homo sapiens
aggcugcggaauucaggac

SEQ ID NO: 5317 - RNA, 23 nt, Homo sapiens
uaaaucccauggugccuucuccu

SEQ ID NO: 5318 - RNA, 21 nt, Homo sapiens
aaacuacugaaaaucaaagau

SEQ ID NO: 5319 - RNA, 21 nt, Homo sapiens
ccugcgagucuccggcggugg

SEQ ID NO: 5320 - RNA, 21 nt, Homo sapiens
gggcuagggccugcugccccc

SEQ ID NO: 5321 - RNA, 21 nt, Homo sapiens
guucaaauccagaucuauaac

SEQ ID NO: 5322 - RNA, 19 nt, Homo sapiens
ccgguuccagucccuggag

SEQ ID NO: 5323 - RNA, 19 nt, Homo sapiens
uucugcugccggccaaggc

SEQ ID NO: 5324 - RNA, 22 nt, Homo sapiens
uccucaucacacugcaccuuag

SEQ ID NO: 5325 - RNA, 20 nt, Homo sapiens
gguagugaguuaucagcuac

SEQ ID NO: 5326 - RNA, 20 nt, Homo sapiens
gauauucagaggcuaggugg

SEQ ID NO: 5327 - RNA, 21 nt, Homo sapiens
acggcccaggcggcauuggug

SEQ ID NO: 5328 - RNA, 21 nt, Homo sapiens
agcaugacagaggagaggugg

SEQ ID NO: 5329 - RNA, 21 nt, Homo sapiens
gggaagagcuguacggccuuc

SEQ ID NO: 5330 - RNA, 19 nt, Homo sapiens
ccgccugagcuagcugugg

SEQ ID NO: 5331 - RNA, 24 nt, Homo sapiens
uuggaagcuuggaccaacuagcug

SEQ ID NO: 5332 - RNA, 25 nt, Homo sapiens
aggggugguguugggacagcuccgu

SEQ ID NO: 5333 - RNA, 19 nt, Homo sapiens
ucuagugcgggcguucccg

SEQ ID NO: 5334 - RNA, 24 nt, Homo sapiens
aggagcagugccggccaaggcgcc

SEQ ID NO: 5335 - RNA, 19 nt, Homo sapiens
gaauacgucugguugaucc

SEQ ID NO: 5336 - RNA, 20 nt, Homo sapiens
cuuauaucagaggcuguggg

SEQ ID NO: 5337 - RNA, 20 nt, Homo sapiens
uuccgccagucgguggccgg

SEQ ID NO: 5338 - RNA, 19 nt, Homo sapiens
aaggggcugggggagcaca

SEQ ID NO: 5339 - RNA, 20 nt, Homo sapiens
ggagguugggaagggcagag

SEQ ID NO: 5340 - RNA, 18 nt, Homo sapiens
ugaggcgggggggcgagc

SEQ ID NO: 5341 - RNA, 20 nt, Homo sapiens
agagaugaagcgggggggcg

SEQ ID NO: 5342 - RNA, 24 nt, Homo sapiens
ggaggccgggguggggcggggcgg

SEQ ID NO: 5343 - RNA, 20 nt, Homo sapiens
aggguguuucucucaucucu

SEQ ID NO: 5344 - RNA, 19 nt, Homo sapiens
ggggagcgaggggcggggc

SEQ ID NO: 5345 - RNA, 21 nt, Homo sapiens
ugagcuaaaugugugcuggga

SEQ ID NO: 5346 - RNA, 23 nt, Homo sapiens
gcgaggaccccucggggucugac

SEQ ID NO: 5347 - RNA, 25 nt, Homo sapiens
gcugggcagggcuucugagcuccuu

SEQ ID NO: 5348 - RNA, 20 nt, Homo sapiens
gggaaaaggaagggggagga

SEQ ID NO: 5349 - RNA, 20 nt, Homo sapiens
gcggaaggcggagcggcgga

SEQ ID NO: 5350 - RNA, 18 nt, Homo sapiens
gugaaggcccggcggaga

SEQ ID NO: 5351 - RNA, 19 nt, Homo sapiens
ugagggagugggugggagg

SEQ ID NO: 5352 - RNA, 19 nt, Homo sapiens
acuggaauuggagucaaaa

SEQ ID NO: 5353 - RNA, 19 nt, Homo sapiens
ugagggaguuggguguaua

SEQ ID NO: 5354 - RNA, 20 nt, Homo sapiens
aggaauguuccuucuuugcc

SEQ ID NO: 5355 - RNA, 19 nt, Homo sapiens
ugagggaguggauuguaug

SEQ ID NO: 5356 - RNA, 19 nt, Homo sapiens
ggcuggucagaugggagug

SEQ ID NO: 5357 - RNA, 19 nt, Homo sapiens
agcagggcuggggauugca

SEQ ID NO: 5358 - RNA, 19 nt, Homo sapiens
ugagggaggagguugggua

SEQ ID NO: 5359 - RNA, 19 nt, Homo sapiens
ugaggugguaggauguaga

SEQ ID NO: 5360 - RNA, 23 nt, Homo sapiens
gaacgccuguucuugccaggugg

SEQ ID NO: 5361 - RNA, 22 nt, Homo sapiens
uccgagccugggucucccucuu

SEQ ID NO: 5362 - RNA, 22 nt, Homo sapiens
ggggguccccggugcucggauc

SEQ ID NO: 5363 - RNA, 22 nt, Homo sapiens
agucauuggaggguuugagcag

SEQ ID NO: 5364 - RNA, 19 nt, Homo sapiens
cagcaggaggugaggggag

SEQ ID NO: 5365 - RNA, 22 nt, Homo sapiens
acucaaaacccuucagugacuu

SEQ ID NO: 5366 - RNA, 22 nt, Homo sapiens
agacuucccauuugaagguggc

SEQ ID NO: 5367 - RNA, 23 nt, Homo sapiens
aaacucuacuuguccuucugagu

SEQ ID NO: 5368 - RNA, 24 nt, Homo sapiens
gaccuggacauguuugugcccagu

SEQ ID NO: 5369 - RNA, 20 nt, Homo sapiens
auggagauagauauagaaau

SEQ ID NO: 5370 - RNA, 21 nt, Homo sapiens
ggcuagcaacagcgcuuaccu

SEQ ID NO: 5371 - RNA, 21 nt, Homo sapiens
acagucugcugagguuggagc

SEQ ID NO: 5372 - RNA, 23 nt, Homo sapiens
aucccuugcaggggcuguugggu

SEQ ID NO: 5373 - RNA, 21 nt, Homo sapiens
cacaagguauugguauuaccu

SEQ ID NO: 5374 - RNA, 22 nt, Homo sapiens
uaguaccaguaccuuguguuca

SEQ ID NO: 5375 - RNA, 22 nt, Homo sapiens
gacuauagaacuuucccccuca

SEQ ID NO: 5376 - RNA, 21 nt, Homo sapiens
agggggaaaguucuauagucc

SEQ ID NO: 5377 - RNA, 19 nt, Homo sapiens
agcugucugaaaaugucuu

SEQ ID NO: 5378 - RNA, 22 nt, Homo sapiens
gugagucucuaagaaaagagga

SEQ ID NO: 5379 - RNA, 21 nt, Homo sapiens
ucuaguaagaguggcagucga

SEQ ID NO: 5380 - RNA, 22 nt, Homo sapiens
augcugacauauuuacuagagg

SEQ ID NO: 5381 - RNA, 22 nt, Homo sapiens
guucucccaacguaagcccagc

SEQ ID NO: 5382 - RNA, 21 nt, Homo sapiens
uggguuuacguugggagaacu

SEQ ID NO: 5383 - RNA, 22 nt, Homo sapiens
aguauucuguaccagggaaggu

SEQ ID NO: 5384 - RNA, 21 nt, Homo sapiens
agaccuggcccagaccucagc

SEQ ID NO: 5385 - RNA, 19 nt, Homo sapiens
gugucugcuuccuguggga

SEQ ID NO: 5386 - RNA, 23 nt, Homo sapiens
cuaauaguaucuaccacaauaaa

SEQ ID NO: 5387 - RNA, 22 nt, Homo sapiens
aaccagcaccccaacuuuggac

SEQ ID NO: 5388 - RNA, 23 nt, Homo sapiens
acuugggcacugaaacaaugucc

SEQ ID NO: 5389 - RNA, 23 nt, Homo sapiens
ugugcuugcucgucccgcccgca

SEQ ID NO: 5390 - RNA, 24 nt, Homo sapiens
acugggggcuuucgggcucugcgu

SEQ ID NO: 5391 - RNA, 25 nt, Homo sapiens
agggaucgcgggcggguggcggccu

SEQ ID NO: 5392 - RNA, 23 nt, Homo sapiens
aucgcugcgguugcgagcgcugu

SEQ ID NO: 5393 - RNA, 21 nt, Homo sapiens
augauccaggaaccugccucu

SEQ ID NO: 5394 - RNA, 24 nt, Homo sapiens
aaagacauaggauagagucaccuc

SEQ ID NO: 5395 - RNA, 22 nt, Homo sapiens
agacacauuuggagagggaacc

SEQ ID NO: 5396 - RNA, 22 nt, Homo sapiens
gucccucuccaaaugugucuug

SEQ ID NO: 5397 - RNA, 22 nt, Homo sapiens
agacacauuuggagagggaccc

SEQ ID NO: 5398 - RNA, 22 nt, Homo sapiens
gguucccucuccaaaugugucu

SEQ ID NO: 5399 - RNA, 22 nt, Homo sapiens
acuuguaugcuagcucagguag

SEQ ID NO: 5400 - RNA, 19 nt, Homo sapiens
aguguggcuuucuuagagc

SEQ ID NO: 5401 - RNA, 19 nt, Homo sapiens
ucuaggcugguacugcuga

SEQ ID NO: 5402 - RNA, 19 nt, Homo sapiens
aagcagcugccucugaggc

SEQ ID NO: 5403 - RNA, 21 nt, Homo sapiens
guggcugcacucacuuccuuc

SEQ ID NO: 5404 - RNA, 19 nt, Homo sapiens
aagugugcagggcacuggu

SEQ ID NO: 5405 - RNA, 22 nt, Homo sapiens
aaaccuguguuguucaagaguc

SEQ ID NO: 5406 - RNA, 22 nt, Homo sapiens
agcaguguuuguuuugcccaca

SEQ ID NO: 5407 - RNA, 22 nt, Homo sapiens
ucgggcgcaagagcacugcagu

SEQ ID NO: 5408 - RNA, 21 nt, Homo sapiens
aggaggcagcgcucucaggac

SEQ ID NO: 5409 - RNA, 21 nt, Homo sapiens
acacuuguugggaugaccugc

SEQ ID NO: 5410 - RNA, 24 nt, Homo sapiens
aggagcuauccacuccaggugucc

SEQ ID NO: 5411 - RNA, 23 nt, Homo sapiens
ccagagcagccugcgguaacagu

SEQ ID NO: 5412 - RNA, 22 nt, Homo sapiens
aguugccagggcugccuuuggu

SEQ ID NO: 5413 - RNA, 21 nt, Homo sapiens
uagaccaucuuucuagaguau

SEQ ID NO: 5414 - RNA, 22 nt, Homo sapiens
agcucuagaaagauuguugacc

SEQ ID NO: 5415 - RNA, 21 nt, Homo sapiens
gggacuaggaugcagaccucc

SEQ ID NO: 5416 - RNA, 23 nt, Homo sapiens
aggucugcauucaaauccccaga

SEQ ID NO: 5417 - RNA, 20 nt, Homo sapiens
cauuacagcacagccauucu

SEQ ID NO: 5418 - RNA, 21 nt, Homo sapiens
ucuggcugugcuguaaugcag

SEQ ID NO: 5419 - RNA, 21 nt, Homo sapiens
ugacuucuaccucuuccaaag

SEQ ID NO: 5420 - RNA, 22 nt, Homo sapiens
uuggaauaggggauaucucagc

SEQ ID NO: 5421 - RNA, 22 nt, Homo sapiens
ucguaucagagauuccagacac

SEQ ID NO: 5422 - RNA, 23 nt, Homo sapiens
acugggaugucacugaauauggu

SEQ ID NO: 5423 - RNA, 22 nt, Homo sapiens
caaaguccuuccuauuuuuccc

SEQ ID NO: 5424 - RNA, 21 nt, Homo sapiens
gaagaauaggagggacuuugu

SEQ ID NO: 5425 - RNA, 22 nt, Homo sapiens
ugggccaugcauuucuagaacu

SEQ ID NO: 5426 - RNA, 21 nt, Homo sapiens
ucuagaaaugcaugacccacc

SEQ ID NO: 5427 - RNA, 22 nt, Homo sapiens
uuccacugccacuaccuaauuu

SEQ ID NO: 5428 - RNA, 21 nt, Homo sapiens
auuagguaguggcaguggaac

SEQ ID NO: 5429 - RNA, 22 nt, Homo sapiens
uuuaggauaagcuugacuuuug

SEQ ID NO: 5430 - RNA, 21 nt, Homo sapiens
caccgacucugucuccugcag

SEQ ID NO: 5431 - RNA, 22 nt, Homo sapiens
cagcaggggagagagaggaguc

SEQ ID NO: 5432 - RNA, 22 nt, Homo sapiens
ccucaccaucccuucugccugc

SEQ ID NO: 5433 - RNA, 23 nt, Homo sapiens
caggcagaaguggggcugacagg

SEQ ID NO: 5434 - RNA, 23 nt, Homo sapiens
ccucaccaccccuucugccugca

SEQ ID NO: 5435 - RNA, 24 nt, Homo sapiens
cugcaggcagaaguggggcugaca

SEQ ID NO: 5436 - RNA, 22 nt, Homo sapiens
uuccagcccuucuaaugguagg

SEQ ID NO: 5437 - RNA, 22 nt, Homo sapiens
uaccauuagaagagcuggaaga

SEQ ID NO: 5438 - RNA, 21 nt, Homo sapiens
ucaagugucaucugucccuag

SEQ ID NO: 5439 - RNA, 23 nt, Homo sapiens
uuugggauugacgccacaugucu

SEQ ID NO: 5440 - RNA, 21 nt, Homo sapiens
cugccuguucuuccacuccag

SEQ ID NO: 5441 - RNA, 23 nt, Homo sapiens
uauggaguggacuuucagcuggc

SEQ ID NO: 5442 - RNA, 20 nt, Homo sapiens
ucucuucaucuaccccccag

SEQ ID NO: 5443 - RNA, 21 nt, Homo sapiens
uuggaggguguggaagacauc

SEQ ID NO: 5444 - RNA, 21 nt, Homo sapiens
aauggcgccacuaggguugug

SEQ ID NO: 5445 - RNA, 25 nt, Homo sapiens
caacccuaggagagggugccauuca

SEQ ID NO: 5446 - RNA, 21 nt, Homo sapiens
guguugaaacaaucucuacug

SEQ ID NO: 5447 - RNA, 22 nt, Homo sapiens
uaugucugcugaccaucaccuu

SEQ ID NO: 5448 - RNA, 22 nt, Homo sapiens
uggugggccgcagaacaugugc

SEQ ID NO: 5449 - RNA, 22 nt, Homo sapiens
auaauacaugguuaaccucuuu

SEQ ID NO: 5450 - RNA, 21 nt, Homo sapiens
aauauuauacagucaaccucu

SEQ ID NO: 5451 - RNA, 23 nt, Homo sapiens
ggcagguucucacccucucuagg

SEQ ID NO: 5452 - RNA, 25 nt, Homo sapiens
ggcggagggaaguagguccguuggu

SEQ ID NO: 5453 - RNA, 22 nt, Homo sapiens
cuugguucagggagggucccca

SEQ ID NO: 5454 - RNA, 22 nt, Homo sapiens
aggaccuucccugaaccaagga

SEQ ID NO: 5455 - RNA, 21 nt, Homo sapiens
accuccugugugcauggauua

SEQ ID NO: 5456 - RNA, 22 nt, Homo sapiens
uacccauugcauaucggaguug

SEQ ID NO: 5457 - RNA, 24 nt, Homo sapiens
ugccugggucucuggccugcgcgu

SEQ ID NO: 5458 - RNA, 21 nt, Homo sapiens
ucccacguuguggcccagcag

SEQ ID NO: 5459 - RNA, 22 nt, Homo sapiens
aggcggggcgccgcgggaccgc

SEQ ID NO: 5460 - RNA, 22 nt, Homo sapiens
gguggcccggccgugccugagg

SEQ ID NO: 5461 - RNA, 23 nt, Homo sapiens
uauucauuuauccccagccuaca

SEQ ID NO: 5462 - RNA, 24 nt, Homo sapiens
acuggcuagggaaaaugauuggau

SEQ ID NO: 5463 - RNA, 22 nt, Homo sapiens
uucauuugccucccagccuaca

SEQ ID NO: 5464 - RNA, 24 nt, Homo sapiens
ugggcuaagggagaugauugggua

SEQ ID NO: 5465 - RNA, 20 nt, Homo sapiens
accaggaggcugaggccccu

SEQ ID NO: 5466 - RNA, 23 nt, Homo sapiens
ugucacucggcucggcccacuac

SEQ ID NO: 5467 - RNA, 20 nt, Homo sapiens
gucccugaguguauguggug

SEQ ID NO: 5468 - RNA, 21 nt, Homo sapiens
uccgguucucagggcuccacc

SEQ ID NO: 5469 - RNA, 21 nt, Homo sapiens
ccaaaccagucgugccugugg

SEQ ID NO: 5470 - RNA, 22 nt, Homo sapiens
cucaaaccggcugugccugugg

SEQ ID NO: 5471 - RNA, 21 nt, Homo sapiens
acaggcacgacugguuuggca

SEQ ID NO: 5472 - RNA, 23 nt, Homo sapiens
aggaagcccuggaggggcuggag

SEQ ID NO: 5473 - RNA, 22 nt, Homo sapiens
uccgaacucuccauuccucugc

SEQ ID NO: 5474 - RNA, 20 nt, Homo sapiens
ugggaauggggguaagggcc

SEQ ID NO: 5475 - RNA, 22 nt, Homo sapiens
aggcgauguggggauguagaga

SEQ ID NO: 5476 - RNA, 21 nt, Homo sapiens
uaguggucagagggcuuauga

SEQ ID NO: 5477 - RNA, 22 nt, Homo sapiens
ucugacaucagugauucuccug

SEQ ID NO: 5478 - RNA, 22 nt, Homo sapiens
cgcgccugcaggaacugguaga

SEQ ID NO: 5479 - RNA, 23 nt, Homo sapiens
ugggcaggggcuuauuguaggag

SEQ ID NO: 5480 - RNA, 22 nt, Homo sapiens
ugcaggggucgggugggccagg

SEQ ID NO: 5481 - RNA, 20 nt, Homo sapiens
aggcgcacccgaccacaugc

SEQ ID NO: 5482 - RNA, 22 nt, Homo sapiens
auaguccgaguaacgucggggc

SEQ ID NO: 5483 - RNA, 23 nt, Homo sapiens
cugggcccgcggcgggcgugggg

SEQ ID NO: 5484 - RNA, 20 nt, Homo sapiens
cuguaugcccucaccgcuca

SEQ ID NO: 5485 - RNA, 23 nt, Homo sapiens
uggugcggagagggcccacagug

SEQ ID NO: 5486 - RNA, 21 nt, Homo sapiens
cuguccuaagguuguugaguu

SEQ ID NO: 5487 - RNA, 21 nt, Homo sapiens
ucuucaaccucaggacuugca

SEQ ID NO: 5488 - RNA, 22 nt, Homo sapiens
caacuagacugugagcuucuag

SEQ ID NO: 5489 - RNA, 23 nt, Homo sapiens
aaggagcuuacaaucuagcuggg

SEQ ID NO: 5490 - RNA, 22 nt, Homo sapiens
gggacccagggagagacguaag

SEQ ID NO: 5491 - RNA, 22 nt, Homo sapiens
caacaaaucacagucugccaua

SEQ ID NO: 5492 - RNA, 21 nt, Homo sapiens
cuuccgccccgccgggcgucg

SEQ ID NO: 5493 - RNA, 22 nt, Homo sapiens
caacaaaucccagucuaccuaa

SEQ ID NO: 5494 - RNA, 22 nt, Homo sapiens
cuguugccacuaaccucaaccu

SEQ ID NO: 5495 - RNA, 22 nt, Homo sapiens
ugcggggcuagggcuaacagca

SEQ ID NO: 5496 - RNA, 22 nt, Homo sapiens
uuugugaccugguccacuaacc

SEQ ID NO: 5497 - RNA, 22 nt, Homo sapiens
gaugguugaccagagagcacac

SEQ ID NO: 5498 - RNA, 22 nt, Homo sapiens
gcagagugcaaacaauuuugac

SEQ ID NO: 5499 - RNA, 23 nt, Homo sapiens
uggaagacuagugauuuuguugu

SEQ ID NO: 5500 - RNA, 20 nt, Homo sapiens
cggcucugggucugugggga

SEQ ID NO: 5501 - RNA, 22 nt, Homo sapiens
gcagcagggugaaacugacaca

SEQ ID NO: 5502 - RNA, 22 nt, Homo sapiens
ggggcuggggccggggccgagc

SEQ ID NO: 5503 - RNA, 22 nt, Homo sapiens
gcaggugcucacuuguccuccu

SEQ ID NO: 5504 - RNA, 21 nt, Homo sapiens
uggaggagaaggaaggugaug

SEQ ID NO: 5505 - RNA, 22 nt, Homo sapiens
acuccagccccacagccucagc

SEQ ID NO: 5506 - RNA, 22 nt, Homo sapiens
aggaggaauuggugcuggucuu

SEQ ID NO: 5507 - RNA, 23 nt, Homo sapiens
ucugcucauaccccaugguuucu

SEQ ID NO: 5508 - RNA, 23 nt, Homo sapiens
ugcaccaugguugucugagcaug

SEQ ID NO: 5509 - RNA, 23 nt, Homo sapiens
cugggaucuccggggucuugguu

SEQ ID NO: 5510 - RNA, 22 nt, Homo sapiens
ugagaccucuggguucugagcu

SEQ ID NO: 5511 - RNA, 23 nt, Homo sapiens
uccaguaccacgugucagggcca

SEQ ID NO: 5512 - RNA, 23 nt, Homo sapiens
caguaacaaagauucauccuugu

SEQ ID NO: 5513 - RNA, 22 nt, Homo sapiens
ggagacugaugaguucccggga

SEQ ID NO: 5514 - RNA, 21 nt, Homo sapiens
gcaggaacuugugagucuccu

SEQ ID NO: 5515 - RNA, 22 nt, Homo sapiens
cugcccuggcccgagggaccga

SEQ ID NO: 5516 - RNA, 21 nt, Homo sapiens
ccuggaaacacugagguugug

SEQ ID NO: 5517 - RNA, 22 nt, Homo sapiens
uauaccucaguuuuaucaggug

SEQ ID NO: 5518 - RNA, 22 nt, Homo sapiens
uggugguuuacaaaguaauuca

SEQ ID NO: 5519 - RNA, 22 nt, Homo sapiens
uggauuucuuugugaaucacca

SEQ ID NO: 5520 - RNA, 21 nt, Homo sapiens
uccucuucucccuccucccag

SEQ ID NO: 5521 - RNA, 20 nt, Homo sapiens
guagaggagauggcgcaggg

SEQ ID NO: 5522 - RNA, 22 nt, Homo sapiens
aggcagcgggguguaguggaua

SEQ ID NO: 5523 - RNA, 22 nt, Homo sapiens
uccauuacacuacccugccucu

SEQ ID NO: 5524 - RNA, 22 nt, Homo sapiens
gugaacgggcgccaucccgagg

SEQ ID NO: 5525 - RNA, 22 nt, Homo sapiens
gacugacaccucuuugggugaa

SEQ ID NO: 5526 - RNA, 21 nt, Homo sapiens
uacucaaaaagcugucaguca

SEQ ID NO: 5527 - RNA, 21 nt, Homo sapiens
uuaauaucggacaaccauugu

SEQ ID NO: 5528 - RNA, 21 nt, Homo sapiens
uacuuggaaaggcaucaguug

SEQ ID NO: 5529 - RNA, 22 nt, Homo sapiens
ugcaacgaaccugagccacuga

SEQ ID NO: 5530 - RNA, 22 nt, Homo sapiens
ugcaacuuaccugagucauuga

SEQ ID NO: 5531 - RNA, 21 nt, Homo sapiens
cacuguguccuuucugcguag

SEQ ID NO: 5532 - RNA, 22 nt, Homo sapiens
cacuggcuccuuucuggguaga

SEQ ID NO: 5533 - RNA, 22 nt, Homo sapiens
cacuguuuccuuucugagugga

SEQ ID NO: 5534 - RNA, 21 nt, Homo sapiens
uauucagaaaggugccaguca

SEQ ID NO: 5535 - RNA, 20 nt, Homo sapiens
ggggagcuguggaagcagua

SEQ ID NO: 5536 - RNA, 25 nt, Homo sapiens
cuagugagggacagaaccaggauuc

SEQ ID NO: 5537 - RNA, 23 nt, Homo sapiens
gcagcagagaauaggacuacguc

SEQ ID NO: 5538 - RNA, 20 nt, Homo sapiens
agagucuugugaugucuugc

SEQ ID NO: 5539 - RNA, 23 nt, Homo sapiens
agguugggaucgguugcaaugcu

SEQ ID NO: 5540 - RNA, 22 nt, Homo sapiens
ggguggggauuuguugcauuac

SEQ ID NO: 5541 - RNA, 22 nt, Homo sapiens
uauugcacuugucccggccugu

SEQ ID NO: 5542 - RNA, 22 nt, Homo sapiens
uauugcacucgucccggccucc

SEQ ID NO: 5543 - RNA, 22 nt, Homo sapiens
agggacgggacgcggugcagug

SEQ ID NO: 5544 - RNA, 22 nt, Homo sapiens
ugugcgcagggagaccucuccc

SEQ ID NO: 5545 - RNA, 22 nt, Homo sapiens
acugcugagcuagcacuucccg

SEQ ID NO: 5546 - RNA, 22 nt, Homo sapiens
ugucuacuacuggagacacugg

SEQ ID NO: 5547 - RNA, 23 nt, Homo sapiens
ccaguuaccgcuuccgcuaccgc

SEQ ID NO: 5548 - RNA, 23 nt, Homo sapiens
caaagugcuguucgugcagguag

SEQ ID NO: 5549 - RNA, 22 nt, Homo sapiens
acaguagagggaggaaucgcag

SEQ ID NO: 5550 - RNA, 22 nt, Homo sapiens
auccgcgcucugacucucugcc

SEQ ID NO: 5551 - RNA, 20 nt, Homo sapiens
gugagucaggguggggcugg

SEQ ID NO: 5552 - RNA, 22 nt, Homo sapiens
ugcccuuaaaggugaacccagu

SEQ ID NO: 5553 - RNA, 21 nt, Homo sapiens
cccugggccucugcuccccag

SEQ ID NO: 5554 - RNA, 24 nt, Homo sapiens
uggggagcugaggcucugggggug

SEQ ID NO: 5555 - RNA, 22 nt, Homo sapiens
auaaagcuagauaaccgaaagu

SEQ ID NO: 5556 - RNA, 21 nt, Homo sapiens
aaggcagggcccccgcucccc

SEQ ID NO: 5557 - RNA, 23 nt, Homo sapiens
cacccggcugugugcacaugugc

SEQ ID NO: 5558 - RNA, 22 nt, Homo sapiens
ucuucucuguuuuggccaugug

SEQ ID NO: 5559 - RNA, 21 nt, Homo sapiens
cugacuguugccguccuccag

SEQ ID NO: 5560 - RNA, 22 nt, Homo sapiens
aaauuauuguacaucggaugag

SEQ ID NO: 5561 - RNA, 22 nt, Homo sapiens
uucaacggguauuuauugagca

SEQ ID NO: 5562 - RNA, 23 nt, Homo sapiens
ucuuugguuaucuagcuguauga

SEQ ID NO: 5563 - RNA, 22 nt, Homo sapiens
aaucaugugcagugccaauaug

SEQ ID NO: 5564 - RNA, 23 nt, Homo sapiens
uuuggcacuagcacauuuuugcu

SEQ ID NO: 5565 - RNA, 22 nt, Homo sapiens
cuauacaacuuacuacuuuccc

SEQ ID NO: 5566 - RNA, 22 nt, Homo sapiens
ugagguaguaaguuguauuguu

SEQ ID NO: 5567 - RNA, 22 nt, Homo sapiens
caagcucgcuucuaugggucug

SEQ ID NO: 5568 - RNA, 22 nt, Homo sapiens
aacccguagauccgaucuugug

SEQ ID NO: 5569 - RNA, 22 nt, Homo sapiens
caagcucgugucuguggguccg

SEQ ID NO: 5570 - RNA, 22 nt, Homo sapiens
cacccguagaaccgaccuugcg

SEQ ID NO: 5571 - RNA, 22 nt, Homo sapiens
uuaaaccucuacuaaguuccca

SEQ ID NO: 5572 - RNA, 18 nt, Homo sapiens
aaaacaacaccccccacc

SEQ ID NO: 5573 - RNA, 22 nt, Homo sapiens
uacuuguaacggagagcacuag

SEQ ID NO: 5574 - RNA, 22 nt, Homo sapiens
uuagccucaugaccagccacaa

SEQ ID NO: 5575 - RNA, 21 nt, Homo sapiens
ugugucugaucaugagacuaa

SEQ ID NO: 5576 - RNA, 22 nt, Homo sapiens
auaaugaaugcuuggucccuug

SEQ ID NO: 5577 - RNA, 22 nt, Homo sapiens
gccugucccuaaauccuuccug

SEQ ID NO: 5578 - RNA, 22 nt, Homo sapiens
gaaucacaaauguccuuaauag

SEQ ID NO: 5579 - RNA, 22 nt, Homo sapiens
aucaaucacaaauguccuuaau

SEQ ID NO: 5580 - RNA, 17 nt, Homo sapiens
cuccucagcucagccuc

SEQ ID NO: 5581 - RNA, 22 nt, Homo sapiens
cugcuccgagcacggccgcgcg

SEQ ID NO: 5582 - RNA, 22 nt, Homo sapiens
augggacauccuacauaugcaa

SEQ ID NO: 5583 - RNA, 21 nt, Homo sapiens
uaaaguaacuuccacuuggcu

SEQ ID NO: 5584 - RNA, 17 nt, Homo sapiens
aaccaccagcccacucc

SEQ ID NO: 5585 - RNA, 22 nt, Homo sapiens
gagccccacugagaaauagaaa

SEQ ID NO: 5586 - RNA, 22 nt, Homo sapiens
cauuuccauagcccacuggguu

SEQ ID NO: 5587 - RNA, 17 nt, Homo sapiens
caacaacagaccacccc

SEQ ID NO: 5588 - RNA, 20 nt, Homo sapiens
uggggcuucucccgccuuuu

SEQ ID NO: 5589 - RNA, 20 nt, Homo sapiens
uuaggguaccgcggccguua

SEQ ID NO: 5590 - RNA, 17 nt, Homo sapiens
ugccagccucgcccagc

SEQ ID NO: 5591 - RNA, 19 nt, Homo sapiens
cugcccuucagccagcucu

SEQ ID NO: 5592 - RNA, 18 nt, Homo sapiens
cgccggagcccgcccccu

SEQ ID NO: 5593 - RNA, 21 nt, Homo sapiens
cguccugcaucacuagcccca

SEQ ID NO: 5594 - RNA, 22 nt, Homo sapiens
uaugcccaaaucucuuaccaga

SEQ ID NO: 5595 - RNA, 22 nt, Homo sapiens
uuuggucacaccaguccacauu

SEQ ID NO: 5596 - RNA, 17 nt, Homo sapiens
ggcgcgcgcccagcccc

SEQ ID NO: 5597 - RNA, 21 nt, Homo sapiens
acagagauggaaaggccuucu

SEQ ID NO: 5598 - RNA, 22 nt, Homo sapiens
ccucuggucagccacagucugg

SEQ ID NO: 5599 - RNA, 21 nt, Homo sapiens
agcaaaaagccuguuuacauu

SEQ ID NO: 5600 - RNA, 22 nt, Homo sapiens
cccucucagcuucaguuuccuc

SEQ ID NO: 5601 - RNA, 17 nt, Homo sapiens
gcccagccgucccggag

SEQ ID NO: 5602 - RNA, 22 nt, Homo sapiens
cagcacuugcccugccagccca

SEQ ID NO: 5603 - RNA, 17 nt, Homo sapiens
ucccuccucucagucuu

SEQ ID NO: 5604 - RNA, 22 nt, Homo sapiens
accagcuaacaauacacugcca

SEQ ID NO: 5605 - RNA, 22 nt, Homo sapiens
aguggcaggguaguuguggcug

SEQ ID NO: 5606 - RNA, 22 nt, Homo sapiens
gccagcuaacaauacacugccu

SEQ ID NO: 5607 - RNA, 23 nt, Homo sapiens
acagagaggagugcaacuagcaa

SEQ ID NO: 5608 - RNA, 25 nt, Homo sapiens
acagccgcuagcaauacacugccua

SEQ ID NO: 5609 - RNA, 17 nt, Homo sapiens
aagaaacuacuaccuca

SEQ ID NO: 5610 - RNA, 21 nt, Homo sapiens
ugauucauccgaggucacaua

SEQ ID NO: 5611 - RNA, 22 nt, Homo sapiens
cuucagcaccaucaucaucagc

SEQ ID NO: 5612 - RNA, 22 nt, Homo sapiens
uaaauucuauuuccugcuuaaa

SEQ ID NO: 5613 - RNA, 22 nt, Homo sapiens
cauguucaucucuauugucaca

SEQ ID NO: 5614 - RNA, 18 nt, Homo sapiens
uccgucccagcccagccu

SEQ ID NO: 5615 - RNA, 20 nt, Homo sapiens
uugccucagaccacccauuu

SEQ ID NO: 5616 - RNA, 20 nt, Homo sapiens
cccagcccagcccaacccag

SEQ ID NO: 5617 - RNA, 17 nt, Homo sapiens
cgcgcgcccagccccgc

SEQ ID NO: 5618 - RNA, 22 nt, Homo sapiens
aaaaccuucuauauccuuuagu

SEQ ID NO: 5619 - RNA, 22 nt, Homo sapiens
augaaugcaaaauguccccaau

SEQ ID NO: 5620 - RNA, 22 nt, Homo sapiens
auauuaggaacacaucgcaaaa

SEQ ID NO: 5621 - RNA, 22 nt, Homo sapiens
uauggaugcaaaaugaucccaa

SEQ ID NO: 5622 - RNA, 22 nt, Homo sapiens
uauucaggaacauauugcaaaa

SEQ ID NO: 5623 - RNA, 22 nt, Homo sapiens
aaccauacauccuacucccuca

SEQ ID NO: 5624 - RNA, 22 nt, Homo sapiens
agggcaaaugcaacaguucuuc

SEQ ID NO: 5625 - RNA, 22 nt, Homo sapiens
ugggcgauacagugaggcccug

SEQ ID NO: 5626 - RNA, 22 nt, Homo sapiens
augggccuccagccgucagucu

SEQ ID NO: 5627 - RNA, 18 nt, Homo sapiens
uuccccaauccugccugu

SEQ ID NO: 5628 - RNA, 22 nt, Homo sapiens
gggcugccgggaguccaguccu

SEQ ID NO: 5629 - RNA, 17 nt, Homo sapiens
gccccgacccuucuccc

SEQ ID NO: 5630 - RNA, 25 nt, Homo sapiens
cucagcugugaguuucaucauauuu

SEQ ID NO: 5631 - RNA, 26 nt, Homo sapiens
ucucagcacaguuaucaucccugagc

SEQ ID NO: 5632 - RNA, 18 nt, Homo sapiens
cagcccugcgcacugcug

SEQ ID NO: 5633 - RNA, 22 nt, Homo sapiens
aacucaguaaugguaacgguuu

SEQ ID NO: 5634 - RNA, 22 nt, Homo sapiens
aaugguaaugguucucuugcua

SEQ ID NO: 5635 - RNA, 22 nt, Homo sapiens
uuccugcguguuuucuguccaa

SEQ ID NO: 5636 - RNA, 20 nt, Homo sapiens
uuggacagaaaacacgcagg

SEQ ID NO: 5637 - RNA, 22 nt, Homo sapiens
accugcguguuuucuguccaaa

SEQ ID NO: 5638 - RNA, 20 nt, Homo sapiens
uuggacagaaaacacgcagg

SEQ ID NO: 5639 - RNA, 22 nt, Homo sapiens
cugagcacaggacuuccuuagc

SEQ ID NO: 5640 - RNA, 21 nt, Homo sapiens
accggccuacaggcagaguca

SEQ ID NO: 5641 - RNA, 21 nt, Homo sapiens
acagccgaggcccucucgguc

SEQ ID NO: 5642 - RNA, 22 nt, Homo sapiens
cacuuacuucuuugcagaugag

SEQ ID NO: 5643 - RNA, 22 nt, Homo sapiens
auagcagcauaagccugucuca

SEQ ID NO: 5644 - RNA, 22 nt, Homo sapiens
ugagacagguucaugcugcuau

SEQ ID NO: 5645 - RNA, 20 nt, Homo sapiens
uagcagcaugaaccugucuc

SEQ ID NO: 5646 - RNA, 21 nt, Homo sapiens
gagacaggcuuaugcugcuau

SEQ ID NO: 5647 - RNA, 21 nt, Homo sapiens
aaccagcaugcacaucccccc

SEQ ID NO: 5648 - RNA, 22 nt, Homo sapiens
ucaguuuccucugcaaacaguu

SEQ ID NO: 5649 - RNA, 22 nt, Homo sapiens
agcggccagcccugcugucagc

SEQ ID NO: 5650 - RNA, 22 nt, Homo sapiens
acagucaucucuuugcagacca

SEQ ID NO: 5651 - RNA, 22 nt, Homo sapiens
guccagaucauacauauaauga

SEQ ID NO: 5652 - RNA, 21 nt, Homo sapiens
acgggccaucagcaguccaau

SEQ ID NO: 5653 - RNA, 22 nt, Homo sapiens
uucauuggacugcugauggccu

SEQ ID NO: 5654 - RNA, 18 nt, Homo sapiens
cgcucccguccugcuggg

SEQ ID NO: 5655 - RNA, 17 nt, Homo sapiens
ucagaagccuucuccau

SEQ ID NO: 5656 - RNA, 17 nt, Homo sapiens
cgccgggcuccccgggg

SEQ ID NO: 5657 - RNA, 22 nt, Homo sapiens
agcguccggcaaccuccuucca

SEQ ID NO: 5658 - RNA, 17 nt, Homo sapiens
agaccccuccuccaucc

SEQ ID NO: 5659 - RNA, 17 nt, Homo sapiens
gucccagccagguccac

SEQ ID NO: 5660 - RNA, 21 nt, Homo sapiens
augugguagauauaugcacga

SEQ ID NO: 5661 - RNA, 21 nt, Homo sapiens
aucgugcauauaucuaccaca

SEQ ID NO: 5662 - RNA, 22 nt, Homo sapiens
cagcuaagcucagcucggcuca

SEQ ID NO: 5663 - RNA, 22 nt, Homo sapiens
ucagcccagcucauccaagcuc

SEQ ID NO: 5664 - RNA, 22 nt, Homo sapiens
gcccagcucagcccaguucagc

SEQ ID NO: 5665 - RNA, 21 nt, Homo sapiens
uaaaccuacaggcaggacuaa

SEQ ID NO: 5666 - RNA, 23 nt, Homo sapiens
acccuauaagcaauauugcacua

SEQ ID NO: 5667 - RNA, 22 nt, Homo sapiens
gcagagacaauauugauagggu

SEQ ID NO: 5668 - RNA, 21 nt, Homo sapiens
guguauaugcccauggacugc

SEQ ID NO: 5669 - RNA, 22 nt, Homo sapiens
cgauguaguccaaaggcacaua

SEQ ID NO: 5670 - RNA, 22 nt, Homo sapiens
cuagagcagcgagagggcggca

SEQ ID NO: 5671 - RNA, 23 nt, Homo sapiens
uccgccacacccacgcugcccuc

SEQ ID NO: 5672 - RNA, 22 nt, Homo sapiens
ugcauaugccuggcuagcuccu

SEQ ID NO: 5673 - RNA, 20 nt, Homo sapiens
gaggagcuagccaggcauau

SEQ ID NO: 5674 - RNA, 19 nt, Homo sapiens
ccccgggccggucgcgccg

SEQ ID NO: 5675 - RNA, 21 nt, Homo sapiens
uugcggguucugacuucaaga

SEQ ID NO: 5676 - RNA, 22 nt, Homo sapiens
cuaaaggcuuugaacacgaguu

SEQ ID NO: 5677 - RNA, 22 nt, Homo sapiens
ucacuugaaucugcaguuagua

SEQ ID NO: 5678 - RNA, 23 nt, Homo sapiens
cggccggcugagcgguguccagg

SEQ ID NO: 5679 - RNA, 21 nt, Homo sapiens
acuuguccaccgcagccgagu

SEQ ID NO: 5680 - RNA, 20 nt, Homo sapiens
gcaaagcaaggugagaguga

SEQ ID NO: 5681 - RNA, 22 nt, Homo sapiens
ucaaucucagccuacuuagcaa

SEQ ID NO: 5682 - RNA, 22 nt, Homo sapiens
gugggccaggaaacagggggug

SEQ ID NO: 5683 - RNA, 23 nt, Homo sapiens
cccaccagcugcucccuggccca

SEQ ID NO: 5684 - RNA, 24 nt, Homo sapiens
ugaggcaaaaguauggcaugggca

SEQ ID NO: 5685 - RNA, 22 nt, Homo sapiens
agccaccaggggacgaugccau

SEQ ID NO: 5686 - RNA, 22 nt, Homo sapiens
uuagcauuuauggucauguguc

SEQ ID NO: 5687 - RNA, 23 nt, Homo sapiens
cuucugucucuuuucucucucca

SEQ ID NO: 5688 - RNA, 22 nt, Homo sapiens
aaccaggcaagaacuacugucu

SEQ ID NO: 5689 - RNA, 19 nt, Homo sapiens
acaauauuucuugccuggu

SEQ ID NO: 5690 - RNA, 21 nt, Homo sapiens
cugggaagggagagggacaau

SEQ ID NO: 5691 - RNA, 22 nt, Homo sapiens
ucccucagcuccucuucccagu

SEQ ID NO: 5692 - RNA, 23 nt, Homo sapiens
uuccucagcacagcaccaucuuc

SEQ ID NO: 5693 - RNA, 20 nt, Homo sapiens
cucccauuugcagucccaca

SEQ ID NO: 5694 - RNA, 21 nt, Homo sapiens
uggggagaggcaggccucaga

SEQ ID NO: 5695 - RNA, 24 nt, Homo sapiens
cucugagagcccaccccucgccca

SEQ ID NO: 5696 - RNA, 21 nt, Homo sapiens
augucaggccucauucuaccu

SEQ ID NO: 5697 - RNA, 19 nt, Homo sapiens
aagguagaaagaggccuga

SEQ ID NO: 5698 - RNA, 20 nt, Homo sapiens
gcccgaccucacccaccccg

SEQ ID NO: 5699 - RNA, 22 nt, Homo sapiens
ugaggggauggguuaacagaac

SEQ ID NO: 5700 - RNA, 22 nt, Homo sapiens
uaguucuauuaaccaguccccu

SEQ ID NO: 5701 - RNA, 23 nt, Homo sapiens
ucuccaagcaacccuuaacucca

SEQ ID NO: 5702 - RNA, 22 nt, Homo sapiens
gguguuaagccuugcucagaga

SEQ ID NO: 5703 - RNA, 22 nt, Homo sapiens
ccagaugccuccagaucccaca

SEQ ID NO: 5704 - RNA, 21 nt, Homo sapiens
ccccggggaccugacgagggu

SEQ ID NO: 5705 - RNA, 22 nt, Homo sapiens
cgacccucugccauccccggug

SEQ ID NO: 5706 - RNA, 23 nt, Homo sapiens
acaggccuccugcccucagccca

SEQ ID NO: 5707 - RNA, 23 nt, Homo sapiens
augccucagaccacuuccacauu

SEQ ID NO: 5708 - RNA, 23 nt, Homo sapiens
auuccuccaggauccacacucac

SEQ ID NO: 5709 - RNA, 22 nt, Homo sapiens
cguugccaugucuaagaagaaa

SEQ ID NO: 5710 - RNA, 22 nt, Homo sapiens
guuuucuucuuagacauggcag

SEQ ID NO: 5711 - RNA, 22 nt, Homo sapiens
agcugccaugucuaagaagaaa

SEQ ID NO: 5712 - RNA, 19 nt, Homo sapiens
uucuucuuagacauggcaa

SEQ ID NO: 5713 - RNA, 23 nt, Homo sapiens
auguguguugcguguauguguau

SEQ ID NO: 5714 - RNA, 23 nt, Homo sapiens
cuccauuuuccaccagagcugca

SEQ ID NO: 5715 - RNA, 22 nt, Homo sapiens
uggacuagcucuguggauccug

SEQ ID NO: 5716 - RNA, 22 nt, Homo sapiens
gucaggauccacagagcuaguu

SEQ ID NO: 5717 - RNA, 22 nt, Homo sapiens
auuuagccaauugucuaucuuu

SEQ ID NO: 5718 - RNA, 22 nt, Homo sapiens
cuaaagauggacaauuggcuaa

SEQ ID NO: 5719 - RNA, 22 nt, Homo sapiens
auuuagccaauuguccaucuuu

SEQ ID NO: 5720 - RNA, 24 nt, Homo sapiens
acugcacguccauggagcucagcu

SEQ ID NO: 5721 - RNA, 22 nt, Homo sapiens
gacggggcucacagaccggaag

SEQ ID NO: 5722 - RNA, 22 nt, Homo sapiens
aacuugcggagugggcacccca

SEQ ID NO: 5723 - RNA, 26 nt, Homo sapiens
ggcgggggcuacgcgccgcggccgag

SEQ ID NO: 5724 - RNA, 23 nt, Homo sapiens
gcucgcgcucacgcgucccccag

SEQ ID NO: 5725 - RNA, 21 nt, Homo sapiens
aaauacaugucagauuguaug

SEQ ID NO: 5726 - RNA, 21 nt, Homo sapiens
ggcauacaaucugacauguau

SEQ ID NO: 5727 - RNA, 23 nt, Homo sapiens
gggaauuacaaucugacaugcaa

SEQ ID NO: 5728 - RNA, 21 nt, Homo sapiens
cuguggggacagaaggaggga

SEQ ID NO: 5729 - RNA, 22 nt, Homo sapiens
gguucuccuucugcuccccagu

SEQ ID NO: 5730 - RNA, 23 nt, Homo sapiens
cuggaaaaacaaaaaggauuuuc

SEQ ID NO: 5731 - RNA, 23 nt, Homo sapiens
gacaaauccuuuuuuuuuucccu

SEQ ID NO: 5732 - RNA, 22 nt, Homo sapiens
ccuccuccacuucccggacaca

SEQ ID NO: 5733 - RNA, 22 nt, Homo sapiens
aagcgaccaugauguaacuuca

SEQ ID NO: 5734 - RNA, 22 nt, Homo sapiens
ugaaguuacaucauggucgcuu

SEQ ID NO: 5735 - RNA, 21 nt, Homo sapiens
agaccaaagacuaugcacuaa

SEQ ID NO: 5736 - RNA, 22 nt, Homo sapiens
agauuagcgcacagucuucggu

SEQ ID NO: 5737 - RNA, 21 nt, Homo sapiens
ugccucuguccagcuguguaa

SEQ ID NO: 5738 - RNA, 22 nt, Homo sapiens
uccaguccggcuccugccugga

SEQ ID NO: 5739 - RNA, 21 nt, Homo sapiens
agccgcgcgucccgagcccag

SEQ ID NO: 5740 - RNA, 22 nt, Homo sapiens
ccugcuggucaaucacagcccc

SEQ ID NO: 5741 - RNA, 22 nt, Homo sapiens
aagagccaguggugaaacagug

SEQ ID NO: 5742 - RNA, 21 nt, Homo sapiens
ucacugucucaccacuggcuc

SEQ ID NO: 5743 - RNA, 22 nt, Homo sapiens
aguaguucuuuggucucacaga

SEQ ID NO: 5744 - RNA, 22 nt, Homo sapiens
uggcugaaagaccaaagaacaa

SEQ ID NO: 5745 - RNA, 22 nt, Homo sapiens
ucauaagucugaacaauaccuu

SEQ ID NO: 5746 - RNA, 22 nt, Homo sapiens
agcaaagaaucucuaucacaga

SEQ ID NO: 5747 - RNA, 21 nt, Homo sapiens
uaacaacucuuacaauucaga

SEQ ID NO: 5748 - RNA, 23 nt, Homo sapiens
acaucuaagacugcaagaguucu

SEQ ID NO: 5749 - RNA, 22 nt, Homo sapiens
agauacagccugcauucccguu

SEQ ID NO: 5750 - RNA, 23 nt, Homo sapiens
agaccaggcuccaggaacucaga

SEQ ID NO: 5751 - RNA, 23 nt, Homo sapiens
aucgggcgagcacuggaucucca

SEQ ID NO: 5752 - RNA, 22 nt, Homo sapiens
acgucuccaccgacuugcaaca

SEQ ID NO: 5753 - RNA, 22 nt, Homo sapiens
uauguugcaagucaguagagag

SEQ ID NO: 5754 - RNA, 22 nt, Homo sapiens
cuagccagggcaggaagggaga

SEQ ID NO: 5755 - RNA, 26 nt, Homo sapiens
aaccuugccccacuccaagcccuggg

SEQ ID NO: 5756 - RNA, 23 nt, Homo sapiens
aacaccagaaagcccagcagaua

SEQ ID NO: 5757 - RNA, 21 nt, Homo sapiens
gccugcccccuccaacagcca

SEQ ID NO: 5758 - RNA, 22 nt, Homo sapiens
uuugggugcgggaggagggcug

SEQ ID NO: 5759 - RNA, 22 nt, Homo sapiens
cccagguccucugcugccccua

SEQ ID NO: 5760 - RNA, 22 nt, Homo sapiens
ggcccccaccaugucuccucaa

SEQ ID NO: 5761 - RNA, 21 nt, Homo sapiens
cagaggccucagcugggcugc

SEQ ID NO: 5762 - RNA, 22 nt, Homo sapiens
uucagcccagccucgccugcuc

SEQ ID NO: 5763 - RNA, 23 nt, Homo sapiens
augcacucucaguccguggcugg

SEQ ID NO: 5764 - RNA, 23 nt, Homo sapiens
ccgcagcucauggccuggaggac

SEQ ID NO: 5765 - RNA, 22 nt, Homo sapiens
aucugauacccacacugccuga

SEQ ID NO: 5766 - RNA, 23 nt, Homo sapiens
aaauacugugaauuccacucuca

SEQ ID NO: 5767 - RNA, 23 nt, Homo sapiens
ugugacagugaaauucacaguau

SEQ ID NO: 5768 - RNA, 21 nt, Homo sapiens
agguguuauccuguccauuug

SEQ ID NO: 5769 - RNA, 22 nt, Homo sapiens
gcaaauggauaggauaacaccu

SEQ ID NO: 5770 - RNA, 22 nt, Homo sapiens
gaaggaggcagcggugagauca

SEQ ID NO: 5771 - RNA, 22 nt, Homo sapiens
ccugcucgcccacugccuccug

SEQ ID NO: 5772 - RNA, 22 nt, Homo sapiens
agaugacaguauccgucuugca

SEQ ID NO: 5773 - RNA, 24 nt, Homo sapiens
accaaggggcaggagucacugaca

SEQ ID NO: 5774 - RNA, 22 nt, Homo sapiens
cacgucagugacugcgcccccu

SEQ ID NO: 5775 - RNA, 23 nt, Homo sapiens
uggggucuuccucuacauuuuga

SEQ ID NO: 5776 - RNA, 22 nt, Homo sapiens
ggagaagauugcagaguaaauu

SEQ ID NO: 5777 - RNA, 22 nt, Homo sapiens
ggaacuuacucugcaaucuucu

SEQ ID NO: 5778 - RNA, 26 nt, Homo sapiens
cacuggggugaggagucaguccugug

SEQ ID NO: 5779 - RNA, 22 nt, Homo sapiens
acacacuguccucauccccaga

SEQ ID NO: 5780 - RNA, 20 nt, Homo sapiens
acaccacacccaucacccau

SEQ ID NO: 5781 - RNA, 22 nt, Homo sapiens
aagggguaggugugguggccaa

SEQ ID NO: 5782 - RNA, 22 nt, Homo sapiens
guggcaauacaauacaacuaca

SEQ ID NO: 5783 - RNA, 23 nt, Homo sapiens
acuauauuuguacuguauugcua

SEQ ID NO: 5784 - RNA, 22 nt, Homo sapiens
uagacacuagauaugugacuga

SEQ ID NO: 5785 - RNA, 22 nt, Homo sapiens
aaucacucacaugccuaguguc

SEQ ID NO: 5786 - RNA, 22 nt, Homo sapiens
acagcaauuaccaagugauuga

SEQ ID NO: 5787 - RNA, 25 nt, Homo sapiens
aagcagcgcccacuuccuccccgcu

SEQ ID NO: 5788 - RNA, 22 nt, Homo sapiens
agaaccucggcuggggcgggcu

SEQ ID NO: 5789 - RNA, 23 nt, Homo sapiens
ccagaacccgcccgcgccggggc

SEQ ID NO: 5790 - RNA, 22 nt, Homo sapiens
aucagagagaugccgccuugcu

SEQ ID NO: 5791 - RNA, 21 nt, Homo sapiens
aaggagcaaggcggcaucucu

SEQ ID NO: 5792 - RNA, 23 nt, Homo sapiens
gcuacagagcaccuccucuucaa

SEQ ID NO: 5793 - RNA, 22 nt, Homo sapiens
uuggagagcaagucacuguugu

SEQ ID NO: 5794 - RNA, 18 nt, Homo sapiens
aaccaccugcccucaccc

SEQ ID NO: 5795 - RNA, 18 nt, Homo sapiens
aucaagccagaagacacg

SEQ ID NO: 5796 - RNA, 23 nt, Homo sapiens
cucaugucuucuggccugaugca

SEQ ID NO: 5797 - RNA, 21 nt, Homo sapiens
auacaguacaggucucucauu

SEQ ID NO: 5798 - RNA, 22 nt, Homo sapiens
gaaaugagagaccuguacugga

SEQ ID NO: 5799 - RNA, 22 nt, Homo sapiens
uucucccacugucuggauccca

SEQ ID NO: 5800 - RNA, 22 nt, Homo sapiens
ugggagccugguagugggagaa

SEQ ID NO: 5801 - RNA, 22 nt, Homo sapiens
caacucugaccaccuagguugg

SEQ ID NO: 5802 - RNA, 22 nt, Homo sapiens
aucaaccuaaggggucagaguu

SEQ ID NO: 5803 - RNA, 23 nt, Homo sapiens
auuggcugcaguuaagguggcac

SEQ ID NO: 5804 - RNA, 22 nt, Homo sapiens
ccaccuuaacugcagccaacuu

SEQ ID NO: 5805 - RNA, 22 nt, Homo sapiens
ucuccauguuuccuucccccuu

SEQ ID NO: 5806 - RNA, 22 nt, Homo sapiens
agaagggggaaggaaacaugga

SEQ ID NO: 5807 - RNA, 21 nt, Homo sapiens
aggccacagccacccaugugu

SEQ ID NO: 5808 - RNA, 22 nt, Homo sapiens
acacauggguggcuguggccua

SEQ ID NO: 5809 - RNA, 21 nt, Homo sapiens
ugcuugguuucagguacagcu

SEQ ID NO: 5810 - RNA, 22 nt, Homo sapiens
ccugcauauuauagauuuguga

SEQ ID NO: 5811 - RNA, 21 nt, Homo sapiens
auacuugguacaacuuaagca

SEQ ID NO: 5812 - RNA, 22 nt, Homo sapiens
aaguuauaccaaauaugccagg

SEQ ID NO: 5813 - RNA, 22 nt, Homo sapiens
ccaccgucaccuggagcccuca

SEQ ID NO: 5814 - RNA, 22 nt, Homo sapiens
cugcagggaggugcuggcaggu

SEQ ID NO: 5815 - RNA, 23 nt, Homo sapiens
caaccuggcacagcccuccugcc

SEQ ID NO: 5816 - RNA, 22 nt, Homo sapiens
uuuggggaggagccagagaggg

SEQ ID NO: 5817 - RNA, 24 nt, Homo sapiens
ugcucuuaucucauggcuccccca

SEQ ID NO: 5818 - RNA, 21 nt, Homo sapiens
acuagcugaaccagaagguac

SEQ ID NO: 5819 - RNA, 23 nt, Homo sapiens
cgaagcucacuccugguucaguu

SEQ ID NO: 5820 - RNA, 22 nt, Homo sapiens
cccgacacugacgccuucccca

SEQ ID NO: 5821 - RNA, 21 nt, Homo sapiens
ggugggaaggcugcagggucu

SEQ ID NO: 5822 - RNA, 22 nt, Homo sapiens
ugcggccagagggaaccugggu

SEQ ID NO: 5823 - RNA, 23 nt, Homo sapiens
ccacuccaggcuccucuggcccu

SEQ ID NO: 5824 - RNA, 22 nt, Homo sapiens
gaaucugccagcuucccacuau

SEQ ID NO: 5825 - RNA, 21 nt, Homo sapiens
ccacuguggaagcuggcagau

SEQ ID NO: 5826 - RNA, 25 nt, Homo sapiens
cuggggcaggagggaggucagcaug

SEQ ID NO: 5827 - RNA, 23 nt, Homo sapiens
ugcuugcugccucuccccuccca

SEQ ID NO: 5828 - RNA, 22 nt, Homo sapiens
uagcuucccaacagauaaauga

SEQ ID NO: 5829 - RNA, 23 nt, Homo sapiens
uggcauggaaugggcuccgccag

SEQ ID NO: 5830 - RNA, 22 nt, Homo sapiens
aguguugggggccacuugugug

SEQ ID NO: 5831 - RNA, 22 nt, Homo sapiens
cacacucauguggcccccagca

SEQ ID NO: 5832 - RNA, 21 nt, Homo sapiens
cagaacaggacaggucagggc

SEQ ID NO: 5833 - RNA, 23 nt, Homo sapiens
agcuuccugcucccugcucuaca

SEQ ID NO: 5834 - RNA, 22 nt, Homo sapiens
aucccaaugcuagaccuggugg

SEQ ID NO: 5835 - RNA, 22 nt, Homo sapiens
caccgggucuagcauugggauu

SEQ ID NO: 5836 - RNA, 22 nt, Homo sapiens
cgcccugaccgcagcccgcagc

SEQ ID NO: 5837 - RNA, 21 nt, Homo sapiens
augucuaauuugagcaccuuu

SEQ ID NO: 5838 - RNA, 22 nt, Homo sapiens
uaccgaagguguucaaauuagg

SEQ ID NO: 5839 - RNA, 19 nt, Homo sapiens
cagcccagauaaccugccu

SEQ ID NO: 5840 - RNA, 20 nt, Homo sapiens
cacugucagcauccucgcau

SEQ ID NO: 5841 - RNA, 22 nt, Homo sapiens
uccuccaggcgcuccaguuuca

SEQ ID NO: 5842 - RNA, 22 nt, Homo sapiens
augaaacugaaaacgcgcuggu

SEQ ID NO: 5843 - RNA, 25 nt, Homo sapiens
agggccccuccgcuccuccucccuu

SEQ ID NO: 5844 - RNA, 22 nt, Homo sapiens
gcagggacggauccucucgggc

SEQ ID NO: 5845 - RNA, 22 nt, Homo sapiens
ccugcccgagaggaucaguccu

SEQ ID NO: 5846 - RNA, 23 nt, Homo sapiens
agccgaccccuccggacagcccg

SEQ ID NO: 5847 - RNA, 23 nt, Homo sapiens
cugcaggcaaaggagaauacaga

SEQ ID NO: 5848 - RNA, 23 nt, Homo sapiens
ucuguaaauaucccuuugccuga

SEQ ID NO: 5849 - RNA, 21 nt, Homo sapiens
cuggaccagaaaagacagaaa

SEQ ID NO: 5850 - RNA, 23 nt, Homo sapiens
augccuccugucccauccggcca

SEQ ID NO: 5851 - RNA, 23 nt, Homo sapiens
cauagcgaagucuagucuuuaga

SEQ ID NO: 5852 - RNA, 23 nt, Homo sapiens
gaccgugagacgucgccgggcca

SEQ ID NO: 5853 - RNA, 23 nt, Homo sapiens
cgccgucccgggagccccacuca

SEQ ID NO: 5854 - RNA, 21 nt, Homo sapiens
ucggcccgcaggagcaccgcu

SEQ ID NO: 5855 - RNA, 23 nt, Homo sapiens
ucugcagguucuccugggaccgg

SEQ ID NO: 5856 - RNA, 22 nt, Homo sapiens
cugggaggaaagcccgggccuu

SEQ ID NO: 5857 - RNA, 22 nt, Homo sapiens
cuaagaccaagccuccuucccu

SEQ ID NO: 5858 - RNA, 21 nt, Homo sapiens
agcaaauccuccccaaaccuc

SEQ ID NO: 5859 - RNA, 20 nt, Homo sapiens
cugugggggcaggaggggcg

SEQ ID NO: 5860 - RNA, 22 nt, Homo sapiens
gaugcccuggccuguccccgca

SEQ ID NO: 5861 - RNA, 22 nt, Homo sapiens
cugcgggagggggugggucagg

SEQ ID NO: 5862 - RNA, 22 nt, Homo sapiens
cacucaaccaccuccgcccgag

SEQ ID NO: 5863 - RNA, 24 nt, Homo sapiens
ccuucuagcagcuacggguccucu

SEQ ID NO: 5864 - RNA, 22 nt, Homo sapiens
agcacauccuugagauccacaa

SEQ ID NO: 5865 - RNA, 22 nt, Homo sapiens
acacaaggcuaaagaaagagaa

SEQ ID NO: 5866 - RNA, 22 nt, Homo sapiens
cuguucucuuccuuuggccuug

SEQ ID NO: 5867 - RNA, 23 nt, Homo sapiens
acuccgcuaacccagguccgcau

SEQ ID NO: 5868 - RNA, 22 nt, Homo sapiens
acuuucccuucagagccuggcu

SEQ ID NO: 5869 - RNA, 22 nt, Homo sapiens
aaagccaggcucugaagggaaa

SEQ ID NO: 5870 - RNA, 22 nt, Homo sapiens
auaggaaggcaaccaucucugg

SEQ ID NO: 5871 - RNA, 23 nt, Homo sapiens
agcagagagugagcgccucccug

SEQ ID NO: 5872 - RNA, 22 nt, Homo sapiens
gcgaagccucugugacgucaug

SEQ ID NO: 5873 - RNA, 23 nt, Homo sapiens
acaccgugacgucacagaggccu

SEQ ID NO: 5874 - RNA, 23 nt, Homo sapiens
gaggguggucagcagguggggca

SEQ ID NO: 5875 - RNA, 23 nt, Homo sapiens
cagccccaccggcucccacucac

SEQ ID NO: 5876 - RNA, 21 nt, Homo sapiens
uaauuccaacaucuaguccua

SEQ ID NO: 5877 - RNA, 22 nt, Homo sapiens
gguuuagauugaacaugaauuu

SEQ ID NO: 5878 - RNA, 22 nt, Homo sapiens
cuaacuucauguucaaucuaaa

SEQ ID NO: 5879 - RNA, 21 nt, Homo sapiens
ggacaaagugcgcaugcccuc

SEQ ID NO: 5880 - RNA, 21 nt, Homo sapiens
ggucaggcaugcacaccuugu

SEQ ID NO: 5881 - RNA, 22 nt, Homo sapiens
caccacaaaucuugaucagaag

SEQ ID NO: 5882 - RNA, 21 nt, Homo sapiens
aggcuucugaucaagauuugg

SEQ ID NO: 5883 - RNA, 24 nt, Homo sapiens
cccgcccagcaccagccccugccu

SEQ ID NO: 5884 - RNA, 21 nt, Homo sapiens
agcaggagggcugggcaggcg

SEQ ID NO: 5885 - RNA, 22 nt, Homo sapiens
ccaugggugugaaaggaguuaa

SEQ ID NO: 5886 - RNA, 21 nt, Homo sapiens
agauaacuccuuccacaucca

SEQ ID NO: 5887 - RNA, 22 nt, Homo sapiens
gaacauagcuaucaaucacuca

SEQ ID NO: 5888 - RNA, 21 nt, Homo sapiens
uuccaaaagagcaauugcuau

SEQ ID NO: 5889 - RNA, 21 nt, Homo sapiens
aacaccaacugcucuuucaga

SEQ ID NO: 5890 - RNA, 23 nt, Homo sapiens
ggcggcggccaggagcgcccgcg

SEQ ID NO: 5891 - RNA, 20 nt, Homo sapiens
auucucucuggaucuccugg

SEQ ID NO: 5892 - RNA, 22 nt, Homo sapiens
auccaugggauccagagagaau

SEQ ID NO: 5893 - RNA, 22 nt, Homo sapiens
guaggggagggaggauggcaga

SEQ ID NO: 5894 - RNA, 24 nt, Homo sapiens
cucauaccuucucuccaucccacc

SEQ ID NO: 5895 - RNA, 18 nt, Homo sapiens
agcuacagugucaucuca

SEQ ID NO: 5896 - RNA, 21 nt, Homo sapiens
uaauuguaggucaagucugcu

SEQ ID NO: 5897 - RNA, 22 nt, Homo sapiens
ucugaucaggcaaaguugcagg

SEQ ID NO: 5898 - RNA, 22 nt, Homo sapiens
agucugcaauuuugccugauca

SEQ ID NO: 5899 - RNA, 22 nt, Homo sapiens
gccuuucuaugcuccuguucug

SEQ ID NO: 5900 - RNA, 21 nt, Homo sapiens
uucuggcacauguuaggcaau

SEQ ID NO: 5901 - RNA, 22 nt, Homo sapiens
uuauuaccuacuacauaccaga

SEQ ID NO: 5902 - RNA, 22 nt, Homo sapiens
agugaccgaaacaaaaaauuaa

SEQ ID NO: 5903 - RNA, 23 nt, Homo sapiens
augcaguggaccaggauggcaag

SEQ ID NO: 5904 - RNA, 22 nt, Homo sapiens
agcccuugccauccugguccac

SEQ ID NO: 5905 - RNA, 22 nt, Homo sapiens
uacagcauucuagaugagguau

SEQ ID NO: 5906 - RNA, 22 nt, Homo sapiens
uauauauaucucucaucuagaa

SEQ ID NO: 5907 - RNA, 22 nt, Homo sapiens
ucaacucugcaaaggaagaaga

SEQ ID NO: 5908 - RNA, 22 nt, Homo sapiens
ccucuucuuccuuuacagaauu

SEQ ID NO: 5909 - RNA, 22 nt, Homo sapiens
cugcuuuuacuauucccuccua

SEQ ID NO: 5910 - RNA, 22 nt, Homo sapiens
gcuagggaucaggcucaagggu

SEQ ID NO: 5911 - RNA, 22 nt, Homo sapiens
cucuagcgaggauuccaacauu

SEQ ID NO: 5912 - RNA, 21 nt, Homo sapiens
ccaauauuggaauccccgcua

SEQ ID NO: 5913 - RNA, 22 nt, Homo sapiens
guucuagauaugaagacaauca

SEQ ID NO: 5914 - RNA, 22 nt, Homo sapiens
uugauugucuucauauccagaa

SEQ ID NO: 5915 - RNA, 23 nt, Homo sapiens
gcagacgcgccccaacaccgggg

SEQ ID NO: 5916 - RNA, 21 nt, Homo sapiens
agcccgggagcugggcgcgcc

SEQ ID NO: 5917 - RNA, 20 nt, Homo sapiens
ucagucccagcaucuccuca

SEQ ID NO: 5918 - RNA, 21 nt, Homo sapiens
gcuggcggcgucgccgacucu

SEQ ID NO: 5919 - RNA, 22 nt, Homo sapiens
gcccagaccagagcuggcuuca

SEQ ID NO: 5920 - RNA, 22 nt, Homo sapiens
ggugcauccaguccuggucuca

SEQ ID NO: 5921 - RNA, 24 nt, Homo sapiens
gcgcggggcagugggcggcgcauc

SEQ ID NO: 5922 - RNA, 22 nt, Homo sapiens
gggaugccgccgccacccccgc

SEQ ID NO: 5923 - RNA, 22 nt, Homo sapiens
gccucccuuagcugguccguaa

SEQ ID NO: 5924 - RNA, 21 nt, Homo sapiens
uauauacaccugcuaugugug

SEQ ID NO: 5925 - RNA, 22 nt, Homo sapiens
cauacacauaucagguguauac

SEQ ID NO: 5926 - RNA, 22 nt, Homo sapiens
ugugacaucgcuuuaccauuca

SEQ ID NO: 5927 - RNA, 20 nt, Homo sapiens
aacaugaaugguaaagcgau

SEQ ID NO: 5928 - RNA, 18 nt, Homo sapiens
uuucagucaucauaucca

SEQ ID NO: 5929 - RNA, 18 nt, Homo sapiens
gccagcgagcgcucaccg

SEQ ID NO: 5930 - RNA, 23 nt, Homo sapiens
agccagccaacucacagugcaga

SEQ ID NO: 5931 - RNA, 24 nt, Homo sapiens
ccucugcccuguggagcaggaugu

SEQ ID NO: 5932 - RNA, 22 nt, Homo sapiens
acagucucgugagauagccaga

SEQ ID NO: 5933 - RNA, 22 nt, Homo sapiens
auccagaaguggcuaauaauau

SEQ ID NO: 5934 - RNA, 21 nt, Homo sapiens
ucaauauuauuagccacuucu

SEQ ID NO: 5935 - RNA, 22 nt, Homo sapiens
gugucuauacucugccacuuua

SEQ ID NO: 5936 - RNA, 22 nt, Homo sapiens
guaaagugacagaguauagaca

SEQ ID NO: 5937 - RNA, 21 nt, Homo sapiens
acagagugccacuuacugaga

SEQ ID NO: 5938 - RNA, 21 nt, Homo sapiens
uucaguaaguggcacucuguc

SEQ ID NO: 5939 - RNA, 22 nt, Homo sapiens
acuucgguauacuucgugaguu

SEQ ID NO: 5940 - RNA, 22 nt, Homo sapiens
ccaauucacaaaguauaccgaa

SEQ ID NO: 5941 - RNA, 22 nt, Homo sapiens
uauauaaaugcagcaugccagu

SEQ ID NO: 5942 - RNA, 22 nt, Homo sapiens
gacuggcaugcugcauuuagau

SEQ ID NO: 5943 - RNA, 19 nt, Homo sapiens
guggacagacggacggaug

SEQ ID NO: 5944 - RNA, 21 nt, Homo sapiens
uccuuccuuccucgguccacu

SEQ ID NO: 5945 - RNA, 22 nt, Homo sapiens
ugagccuugguuuucuugugua

SEQ ID NO: 5946 - RNA, 23 nt, Homo sapiens
gcuugaagguuuccauccaugua

SEQ ID NO: 5947 - RNA, 22 nt, Homo sapiens
aacauggucuagaaccuccaua

SEQ ID NO: 5948 - RNA, 21 nt, Homo sapiens
ucaauccacacuauuauguua

SEQ ID NO: 5949 - RNA, 21 nt, Homo sapiens
uuucgagggcaagguuaagca

SEQ ID NO: 5950 - RNA, 21 nt, Homo sapiens
uugcuuaaccuuaccguccaa

SEQ ID NO: 5951 - RNA, 21 nt, Homo sapiens
aagacgggaggagaggaguga

SEQ ID NO: 5952 - RNA, 22 nt, Homo sapiens
cucccuucuuuccucccgucuu

SEQ ID NO: 5953 - RNA, 22 nt, Homo sapiens
aucgggaggggacugagccuga

SEQ ID NO: 5954 - RNA, 22 nt, Homo sapiens
agagaggagagccguguaugac

SEQ ID NO: 5955 - RNA, 22 nt, Homo sapiens
gaauucaucacggccagccucu

SEQ ID NO: 5956 - RNA, 21 nt, Homo sapiens
auccuguacugagcugccccg

SEQ ID NO: 5957 - RNA, 22 nt, Homo sapiens
cucggggcagcucaguacagga

SEQ ID NO: 5958 - RNA, 22 nt, Homo sapiens
aacuggaugucccuguaugauu

SEQ ID NO: 5959 - RNA, 22 nt, Homo sapiens
aaguggaugacccuguacgauu

SEQ ID NO: 5960 - RNA, 21 nt, Homo sapiens
gaccaagaaauagccuuucaa

SEQ ID NO: 5961 - RNA, 21 nt, Homo sapiens
uugagagugccauuaucuggg

SEQ ID NO: 5962 - RNA, 22 nt, Homo sapiens
gcugccguauaugugaugucac

SEQ ID NO: 5963 - RNA, 22 nt, Homo sapiens
cagcauggaguccuccagguug

SEQ ID NO: 5964 - RNA, 20 nt, Homo sapiens
acccaccuggagauccaugg

SEQ ID NO: 5965 - RNA, 22 nt, Homo sapiens
guagaagggaaucuugcauaag

SEQ ID NO: 5966 - RNA, 22 nt, Homo sapiens
ccucauggaaggguuccccacu

SEQ ID NO: 5967 - RNA, 23 nt, Homo sapiens
aagaaucuugucccgcagguccu

SEQ ID NO: 5968 - RNA, 22 nt, Homo sapiens
ccuggcacacaguagaccuuca

SEQ ID NO: 5969 - RNA, 22 nt, Homo sapiens
aaugaaagccuaccauguacaa

SEQ ID NO: 5970 - RNA, 22 nt, Homo sapiens
gagguuucccguguauguuuca

SEQ ID NO: 5971 - RNA, 22 nt, Homo sapiens
aagaagugcaccauguuuguuu

SEQ ID NO: 5972 - RNA, 22 nt, Homo sapiens
cgaaaauaacaugggcaacuuc

SEQ ID NO: 5973 - RNA, 22 nt, Homo sapiens
gagauuggccauguaauacuca

SEQ ID NO: 5974 - RNA, 22 nt, Homo sapiens
ucuaacaccacagugugguuug

SEQ ID NO: 5975 - RNA, 21 nt, Homo sapiens
acaaaccacagugugcugcug

SEQ ID NO: 5976 - RNA, 23 nt, Homo sapiens
gaaaaacgcccccuggcuugaaa

SEQ ID NO: 5977 - RNA, 20 nt, Homo sapiens
acuguauugucagguaguga

SEQ ID NO: 5978 - RNA, 21 nt, Homo sapiens
ucacuaccugacaauacagca

SEQ ID NO: 5979 - RNA, 22 nt, Homo sapiens
agcacagacuugcugugauguu

SEQ ID NO: 5980 - RNA, 21 nt, Homo sapiens
aaacaucacugcaagucuuaa

SEQ ID NO: 5981 - RNA, 22 nt, Homo sapiens
uguuaagacuugcagugauguu

SEQ ID NO: 5982 - RNA, 21 nt, Homo sapiens
ugaacaucacagcaagucugu

SEQ ID NO: 5983 - RNA, 22 nt, Homo sapiens
uccaaguucagaaguguccuga

SEQ ID NO: 5984 - RNA, 22 nt, Homo sapiens
acucaggaacacuucugaacug

SEQ ID NO: 5985 - RNA, 22 nt, Homo sapiens
aaggaccuggacagaggcagaa

SEQ ID NO: 5986 - RNA, 24 nt, Homo sapiens
agcuccgccgcugaguccagcccu

SEQ ID NO: 5987 - RNA, 21 nt, Homo sapiens
aaguggucagugaggcaguca

SEQ ID NO: 5988 - RNA, 24 nt, Homo sapiens
acuaagugccucagaaaccaaauu

SEQ ID NO: 5989 - RNA, 21 nt, Homo sapiens
ccccaacaaccuagaaaagua

SEQ ID NO: 5990 - RNA, 23 nt, Homo sapiens
ucuacccugcaagguuguuguga

SEQ ID NO: 5991 - RNA, 22 nt, Homo sapiens
cugaggcccaggaaaauccaag

SEQ ID NO: 5992 - RNA, 22 nt, Homo sapiens
ucgugaauuugcccuguccuca

SEQ ID NO: 5993 - RNA, 21 nt, Homo sapiens
cugccaggauggaaagggaaa

SEQ ID NO: 5994 - RNA, 21 nt, Homo sapiens
uuccaccuccugcccuggcaa

SEQ ID NO: 5995 - RNA, 22 nt, Homo sapiens
auuagaguuugguucauaugau

SEQ ID NO: 5996 - RNA, 22 nt, Homo sapiens
aaaccauaucagccagacucua

SEQ ID NO: 5997 - RNA, 21 nt, Homo sapiens
gcgaggcccugggagcacagg

SEQ ID NO: 5998 - RNA, 22 nt, Homo sapiens
ccacugugccccaagggccuca

SEQ ID NO: 5999 - RNA, 22 nt, Homo sapiens
uuuuggacuuucagauuuagga

SEQ ID NO: 6000 - RNA, 24 nt, Homo sapiens
auccccaaaucugaaaaaguccaa

SEQ ID NO: 6001 - RNA, 22 nt, Homo sapiens
cagaauccuugcccaggugcau

SEQ ID NO: 6002 - RNA, 23 nt, Homo sapiens
ucucacccagguagcaaggauua

SEQ ID NO: 6003 - RNA, 18 nt, Homo sapiens
acccagguagcaaggauu

SEQ ID NO: 6004 - RNA, 22 nt, Homo sapiens
cuggggaaugggagacacaaaa

SEQ ID NO: 6005 - RNA, 22 nt, Homo sapiens
aauuuugcucugccaucccccu

SEQ ID NO: 6006 - RNA, 22 nt, Homo sapiens
uguuauauauacagccaugcac

SEQ ID NO: 6007 - RNA, 21 nt, Homo sapiens
gagugcauggcuguauauaua

SEQ ID NO: 6008 - RNA, 22 nt, Homo sapiens
agaauccuugcccgggugcauu

SEQ ID NO: 6009 - RNA, 22 nt, Homo sapiens
ucucacccagggacaaaggauu

SEQ ID NO: 6010 - RNA, 22 nt, Homo sapiens
ugaauccuugcccaggugcauu

SEQ ID NO: 6011 - RNA, 21 nt, Homo sapiens
uagcacccagauagcaaggau

SEQ ID NO: 6012 - RNA, 23 nt, Homo sapiens
ccuggcagcggaaacaauacccc

SEQ ID NO: 6013 - RNA, 23 nt, Homo sapiens
cugcagaacuguucccgcugcua

SEQ ID NO: 6014 - RNA, 22 nt, Homo sapiens
gauagagugcagaccagggucu

SEQ ID NO: 6015 - RNA, 21 nt, Homo sapiens
accuuacaaccgcagcugcaa

SEQ ID NO: 6016 - RNA, 22 nt, Homo sapiens
aggaaaccagcaaguguugacg

SEQ ID NO: 6017 - RNA, 22 nt, Homo sapiens
acaucaauacuuccuggcuccc

SEQ ID NO: 6018 - RNA, 21 nt, Homo sapiens
ucuacucagaagggugccuua

SEQ ID NO: 6019 - RNA, 22 nt, Homo sapiens
uuaaguaacaccuuccugaaua

SEQ ID NO: 6020 - RNA, 21 nt, Homo sapiens
uucacuccaaaaggugcaaaa

SEQ ID NO: 6021 - RNA, 23 nt, Homo sapiens
ucuacuccaaaaggcuacaauca

SEQ ID NO: 6022 - RNA, 23 nt, Homo sapiens
caugagugacgcccucuggagua

SEQ ID NO: 6023 - RNA, 23 nt, Homo sapiens
caugccagcaaagcuacaaaccc

SEQ ID NO: 6024 - RNA, 23 nt, Homo sapiens
cuccauccaaucccugagcccug

SEQ ID NO: 6025 - RNA, 23 nt, Homo sapiens
ucagugggauuuccgaguagcau

SEQ ID NO: 6026 - RNA, 21 nt, Homo sapiens
gaugcuacucagaaaucccac

SEQ ID NO: 6027 - RNA, 23 nt, Homo sapiens
cacccuacaccaaucugccccgg

SEQ ID NO: 6028 - RNA, 23 nt, Homo sapiens
cagcacagucuugucgucuccgu

SEQ ID NO: 6029 - RNA, 22 nt, Homo sapiens
gaugccaagcucagcguggauu

SEQ ID NO: 6030 - RNA, 23 nt, Homo sapiens
gcuccuagccagccucauuuccu

SEQ ID NO: 6031 - RNA, 22 nt, Homo sapiens
caugauugccacgucugcagua

SEQ ID NO: 6032 - RNA, 22 nt, Homo sapiens
cuacccacagacguaccaauca

SEQ ID NO: 6033 - RNA, 22 nt, Homo sapiens
agguucaaggcauucacugauu

SEQ ID NO: 6034 - RNA, 21 nt, Homo sapiens
cgcggugguucacgccuguaa

SEQ ID NO: 6035 - RNA, 21 nt, Homo sapiens
ugauugccacugucugcagua

SEQ ID NO: 6036 - RNA, 21 nt, Homo sapiens
gccugaccaacauggugaaac

SEQ ID NO: 6037 - RNA, 22 nt, Homo sapiens
gugauugccacucuccugagua

SEQ ID NO: 6038 - RNA, 22 nt, Homo sapiens
agaggcaccgcugggaucugaa

SEQ ID NO: 6039 - RNA, 21 nt, Homo sapiens
ugacugcagagcaaaagacac

SEQ ID NO: 6040 - RNA, 22 nt, Homo sapiens
gaccucagcuaugacagcacuu

SEQ ID NO: 6041 - RNA, 23 nt, Homo sapiens
gaaagugcccucaaggcugagug

SEQ ID NO: 6042 - RNA, 23 nt, Homo sapiens
ccuucucagaaaggugaaauuua

SEQ ID NO: 6043 - RNA, 18 nt, Homo sapiens
augacaccucccugugaa

SEQ ID NO: 6044 - RNA, 22 nt, Homo sapiens
auaaaugacaccuccuugugaa

SEQ ID NO: 6045 - RNA, 23 nt, Homo sapiens
ucuucucagaaaggugaaauuua

SEQ ID NO: 6046 - RNA, 22 nt, Homo sapiens
auaaacgacaccuccuugagaa

SEQ ID NO: 6047 - RNA, 21 nt, Homo sapiens
ucuacucacagaagugucaau

SEQ ID NO: 6048 - RNA, 23 nt, Homo sapiens
caugauugucacucuccagagua

SEQ ID NO: 6049 - RNA, 21 nt, Homo sapiens
uccacucacagaggugucaau

SEQ ID NO: 6050 - RNA, 22 nt, Homo sapiens
augauugccucccucuugagaa

SEQ ID NO: 6051 - RNA, 22 nt, Homo sapiens
aacgcuccaaaagaaggcacuc

SEQ ID NO: 6052 - RNA, 24 nt, Homo sapiens
cagaaagugcuuucuuuuggagaa

SEQ ID NO: 6053 - RNA, 18 nt, Homo sapiens
acccucugaaaggaagca

SEQ ID NO: 6054 - RNA, 23 nt, Homo sapiens
gaaagugcuucuuuccucgagaa

SEQ ID NO: 6055 - RNA, 18 nt, Homo sapiens
acccucugaaaggaagca

SEQ ID NO: 6056 - RNA, 22 nt, Homo sapiens
aaagugcuucuuaccuccagau

SEQ ID NO: 6057 - RNA, 22 nt, Homo sapiens
agacagugcuuccaucuagagg

SEQ ID NO: 6058 - RNA, 22 nt, Homo sapiens
acacucuaaagggaugcacgau

SEQ ID NO: 6059 - RNA, 22 nt, Homo sapiens
acacucuaaagggaugcacgau

SEQ ID NO: 6060 - RNA, 22 nt, Homo sapiens
acacucuaaaaggaugcacgau

SEQ ID NO: 6061 - RNA, 21 nt, Homo sapiens
accugauuucuaccaaucucu

SEQ ID NO: 6062 - RNA, 21 nt, Homo sapiens
cugaggaaaagaggauucagu

SEQ ID NO: 6063 - RNA, 22 nt, Homo sapiens
uccacuucaaucccucauccca

SEQ ID NO: 6064 - RNA, 23 nt, Homo sapiens
cuccgguuuaaauggguccgauu

SEQ ID NO: 6065 - RNA, 24 nt, Homo sapiens
ccuguccauccgccugugcccaga

SEQ ID NO: 6066 - RNA, 22 nt, Homo sapiens
uccagcaaagggaagcgcuuuc

SEQ ID NO: 6067 - RNA, 20 nt, Homo sapiens
gaaagggcuucccuuugcag

SEQ ID NO: 6068 - RNA, 22 nt, Homo sapiens
accucuaaaggggagcgcuuug

SEQ ID NO: 6069 - RNA, 23 nt, Homo sapiens
acacucuaaagagaagcgcuuug

SEQ ID NO: 6070 - RNA, 23 nt, Homo sapiens
cagaaagugcuucccuccagaga

SEQ ID NO: 6071 - RNA, 21 nt, Homo sapiens
gcuccaaagggaagcgcuuug

SEQ ID NO: 6072 - RNA, 22 nt, Homo sapiens
cagaaagugcuucccucuagag

SEQ ID NO: 6073 - RNA, 21 nt, Homo sapiens
cacucugaagggaagcgcuuu

SEQ ID NO: 6074 - RNA, 22 nt, Homo sapiens
cagaaagcgcuucccucuagag

SEQ ID NO: 6075 - RNA, 21 nt, Homo sapiens
ccucuaaagagaagcgcuuuc

SEQ ID NO: 6076 - RNA, 22 nt, Homo sapiens
gagaaagugcuucccucuagag

SEQ ID NO: 6077 - RNA, 21 nt, Homo sapiens
uggcuccagcucagucacugg

SEQ ID NO: 6078 - RNA, 22 nt, Homo sapiens
agcacuucauucuuccuauccu

SEQ ID NO: 6079 - RNA, 22 nt, Homo sapiens
accaccuggaauccacucuccu

SEQ ID NO: 6080 - RNA, 22 nt, Homo sapiens
acugggaugagguagaggagga

SEQ ID NO: 6081 - RNA, 22 nt, Homo sapiens
ccaucccauuccaaaccccuca

SEQ ID NO: 6082 - RNA, 21 nt, Homo sapiens
agcccccucagagaacuggau

SEQ ID NO: 6083 - RNA, 22 nt, Homo sapiens
ccauccaguugccuuagggguu

SEQ ID NO: 6084 - RNA, 21 nt, Homo sapiens
cugggagggagacgaggauga

SEQ ID NO: 6085 - RNA, 22 nt, Homo sapiens
cccaacccucguccccuucccu

SEQ ID NO: 6086 - RNA, 23 nt, Homo sapiens
auucgaugacucagucucuucuu

SEQ ID NO: 6087 - RNA, 23 nt, Homo sapiens
ucaagaaugaguuugugccauug

SEQ ID NO: 6088 - RNA, 22 nt, Homo sapiens
acacucuaaaaggaugcacuuu

SEQ ID NO: 6089 - RNA, 22 nt, Homo sapiens
cagaaagcgcuucccucuagag

SEQ ID NO: 6090 - RNA, 22 nt, Homo sapiens
aaccucuaaaaggaugcacuuu

SEQ ID NO: 6091 - RNA, 22 nt, Homo sapiens
cagaaagcgcuucccucuagag

SEQ ID NO: 6092 - RNA, 22 nt, Homo sapiens
auccucuaaaaagaugcacuuu

SEQ ID NO: 6093 - RNA, 22 nt, Homo sapiens
cagaaagcgcuucccucuagag

SEQ ID NO: 6094 - RNA, 22 nt, Homo sapiens
cacucuaaagggaggcacuuug

SEQ ID NO: 6095 - RNA, 22 nt, Homo sapiens
aacacucuaaaaggaggcacuu

SEQ ID NO: 6096 - RNA, 22 nt, Homo sapiens
gaaagugcucccuuuuggagaa

SEQ ID NO: 6097 - RNA, 22 nt, Homo sapiens
acaguccaaagggaagcacuuu

SEQ ID NO: 6098 - RNA, 21 nt, Homo sapiens
agaaaguacuucccucuggag

SEQ ID NO: 6099 - RNA, 21 nt, Homo sapiens
cccucuaaaaggaagcacuuu

SEQ ID NO: 6100 - RNA, 22 nt, Homo sapiens
acccucuaaaaggaagcacuuu

SEQ ID NO: 6101 - RNA, 22 nt, Homo sapiens
cagaaagugcuucccucuagag

SEQ ID NO: 6102 - RNA, 22 nt, Homo sapiens
acccaccaaagagaagcacuuu

SEQ ID NO: 6103 - RNA, 20 nt, Homo sapiens
gaaagggcuucccuuuguag

SEQ ID NO: 6104 - RNA, 21 nt, Homo sapiens
cccucaaaaaggaagcacuuu

SEQ ID NO: 6105 - RNA, 22 nt, Homo sapiens
aacccucuaaaaggaagcacuu

SEQ ID NO: 6106 - RNA, 24 nt, Homo sapiens
acacucuaaagggaagcacuuugu

SEQ ID NO: 6107 - RNA, 22 nt, Homo sapiens
acucuaaagggaagcacuuugu

SEQ ID NO: 6108 - RNA, 22 nt, Homo sapiens
acacucuaaagggaagugcguu

SEQ ID NO: 6109 - RNA, 22 nt, Homo sapiens
acacucuaaagggaaccauuuu

SEQ ID NO: 6110 - RNA, 22 nt, Homo sapiens
cagaaagcgcuucccucuagag

SEQ ID NO: 6111 - RNA, 23 nt, Homo sapiens
acccucuauagggaagcgcguuc

SEQ ID NO: 6112 - RNA, 22 nt, Homo sapiens
cagaaagcgcuucccucuagag

SEQ ID NO: 6113 - RNA, 21 nt, Homo sapiens
acuccaaagggaagcgccuuc

SEQ ID NO: 6114 - RNA, 22 nt, Homo sapiens
gagaaagugcuucccuuuguag

SEQ ID NO: 6115 - RNA, 22 nt, Homo sapiens
cgcucuaaagggaagcgccuuc

SEQ ID NO: 6116 - RNA, 21 nt, Homo sapiens
agaaagugcaucccucuggag

SEQ ID NO: 6117 - RNA, 22 nt, Homo sapiens
cagaaagugcuucccucuagag

SEQ ID NO: 6118 - RNA, 22 nt, Homo sapiens
gccucuaaaaggaagcacuuuc

SEQ ID NO: 6119 - RNA, 23 nt, Homo sapiens
acagaaagugcuucccucaagag

SEQ ID NO: 6120 - RNA, 20 nt, Homo sapiens
gaaagggcuucccuuugcag

SEQ ID NO: 6121 - RNA, 22 nt, Homo sapiens
ugcaagccuugggugugggagg

SEQ ID NO: 6122 - RNA, 22 nt, Homo sapiens
acgguccuacacucaaggcaug

SEQ ID NO: 6123 - RNA, 22 nt, Homo sapiens
aaagaaauuguccuuguaugau

SEQ ID NO: 6124 - RNA, 22 nt, Homo sapiens
acacaccaaggauaauuucucc

SEQ ID NO: 6125 - RNA, 22 nt, Homo sapiens
aguccagauucugugcccacca

SEQ ID NO: 6126 - RNA, 25 nt, Homo sapiens
agugggaccgacagcagaauccuuu

SEQ ID NO: 6127 - RNA, 22 nt, Homo sapiens
uuucaguuaucaaucugucaca

SEQ ID NO: 6128 - RNA, 23 nt, Homo sapiens
ucucgugacaugaugauccccga

SEQ ID NO: 6129 - RNA, 22 nt, Homo sapiens
aagaagugcaccgcgaauguuu

SEQ ID NO: 6130 - RNA, 22 nt, Homo sapiens
gaacuugcuaaaaaugcagaau

SEQ ID NO: 6131 - RNA, 22 nt, Homo sapiens
uuagaaaugcacaaccucaggu

SEQ ID NO: 6132 - RNA, 22 nt, Homo sapiens
gcacacaauaaauguuugcuga

SEQ ID NO: 6133 - RNA, 22 nt, Homo sapiens
ucaucuaauaaacauuuacuga

SEQ ID NO: 6134 - RNA, 22 nt, Homo sapiens
uggugcaaaaguaacuguagcu

SEQ ID NO: 6135 - RNA, 20 nt, Homo sapiens
gaaaguaauugcaguuuuua

SEQ ID NO: 6136 - RNA, 23 nt, Homo sapiens
caaaaacugcaauuacuuuugca

SEQ ID NO: 6137 - RNA, 22 nt, Homo sapiens
uggcaaaaccgcaauuacuucu

SEQ ID NO: 6138 - RNA, 22 nt, Homo sapiens
gcaaaaguaauugccaguuuug

SEQ ID NO: 6139 - RNA, 22 nt, Homo sapiens
gguaaaacucgcaauuacuuuu

SEQ ID NO: 6140 - RNA, 25 nt, Homo sapiens
uggugcaaaaguaauugugguuuuu

SEQ ID NO: 6141 - RNA, 22 nt, Homo sapiens
agcaaaauccacaauuacuuuu

SEQ ID NO: 6142 - RNA, 22 nt, Homo sapiens
caaaaguaauugccgguuuuug

SEQ ID NO: 6143 - RNA, 22 nt, Homo sapiens
ugcaaaagucauugucguuuuc

SEQ ID NO: 6144 - RNA, 21 nt, Homo sapiens
ugaaaguaauugcaguuuuug

SEQ ID NO: 6145 - RNA, 21 nt, Homo sapiens
gcagaaaccacaauuaccuuu

SEQ ID NO: 6146 - RNA, 22 nt, Homo sapiens
gcaaaaguaacugcaguuuuug

SEQ ID NO: 6147 - RNA, 20 nt, Homo sapiens
caaacacugcaaucacuuuu

SEQ ID NO: 6148 - RNA, 22 nt, Homo sapiens
gggaaaaacugcaauuaccuuu

SEQ ID NO: 6149 - RNA, 21 nt, Homo sapiens
uaaaaguaauugcaguuuuua

SEQ ID NO: 6150 - RNA, 23 nt, Homo sapiens
caaaaacugcaauuacuuuugca

SEQ ID NO: 6151 - RNA, 21 nt, Homo sapiens
ucaaaaaccgcaguuacuuuu

SEQ ID NO: 6152 - RNA, 22 nt, Homo sapiens
ugguacaaaagucauugccguu

SEQ ID NO: 6153 - RNA, 22 nt, Homo sapiens
acaaaaguaacugcaguuuuug

SEQ ID NO: 6154 - RNA, 22 nt, Homo sapiens
ggcaaaaaccgcaauuacuuuu

SEQ ID NO: 6155 - RNA, 20 nt, Homo sapiens
caaaaaccacaaugccuuuu

SEQ ID NO: 6156 - RNA, 22 nt, Homo sapiens
ugcaaaaguagucacggucuuu

SEQ ID NO: 6157 - RNA, 22 nt, Homo sapiens
ugcaaaaaccguaguuacuucu

SEQ ID NO: 6158 - RNA, 19 nt, Homo sapiens
aaaaguaauugugguuuuu

SEQ ID NO: 6159 - RNA, 19 nt, Homo sapiens
aaagaccgcaauuacuuuu

SEQ ID NO: 6160 - RNA, 22 nt, Homo sapiens
gcaaaaguaauugcaguuuuug

SEQ ID NO: 6161 - RNA, 22 nt, Homo sapiens
ggcaaaaacagcaauuacuuuc

SEQ ID NO: 6162 - RNA, 21 nt, Homo sapiens
gcaaaaauaacugcaguuuua

SEQ ID NO: 6163 - RNA, 21 nt, Homo sapiens
gcaaaaacugcaauuacuuuu

SEQ ID NO: 6164 - RNA, 22 nt, Homo sapiens
acaaacauaauuguggguuuua

SEQ ID NO: 6165 - RNA, 22 nt, Homo sapiens
ggcaaaacccgcaauuacuuuu

SEQ ID NO: 6166 - RNA, 21 nt, Homo sapiens
acaaaaguuacugcgguuuug

SEQ ID NO: 6167 - RNA, 22 nt, Homo sapiens
agccaaaaccgcaauaacuuuu

SEQ ID NO: 6168 - RNA, 21 nt, Homo sapiens
cuggugcaaaaguaacugcca

SEQ ID NO: 6169 - RNA, 21 nt, Homo sapiens
gcaaaaaccgcaauuacuuuu

SEQ ID NO: 6170 - RNA, 20 nt, Homo sapiens
gcaaaaguaacugcaguuuu

SEQ ID NO: 6171 - RNA, 18 nt, Homo sapiens
aaauccgcaaguacuuuu

SEQ ID NO: 6172 - RNA, 20 nt, Homo sapiens
aaccgugaugacuuuugcac

SEQ ID NO: 6173 - RNA, 22 nt, Homo sapiens
ugcaagaguaaucgcgguuuug

SEQ ID NO: 6174 - RNA, 21 nt, Homo sapiens
gcaaaaaccacaauuacuuuu

SEQ ID NO: 6175 - RNA, 21 nt, Homo sapiens
gcaaaagugauugcaguuuuu

SEQ ID NO: 6176 - RNA, 22 nt, Homo sapiens
gcaaaaaccacaaucacuuuug

SEQ ID NO: 6177 - RNA, 22 nt, Homo sapiens
acaaaagcaacugagguucuug

SEQ ID NO: 6178 - RNA, 22 nt, Homo sapiens
ggccaaaaccacaauuacuuuu

SEQ ID NO: 6179 - RNA, 22 nt, Homo sapiens
gcaaaaguaauugagauuuuug

SEQ ID NO: 6180 - RNA, 22 nt, Homo sapiens
ggcaaaaaccgcaauuacuuuu

SEQ ID NO: 6181 - RNA, 22 nt, Homo sapiens
gcaaaagaaacugugguuuuug

SEQ ID NO: 6182 - RNA, 22 nt, Homo sapiens
ggcaaaaaccacaauuacuuuu

SEQ ID NO: 6183 - RNA, 22 nt, Homo sapiens
ugcaaaaguagucucaguuuuu

SEQ ID NO: 6184 - RNA, 19 nt, Homo sapiens
aaaaguaauuacaguuuuu

SEQ ID NO: 6185 - RNA, 22 nt, Homo sapiens
guacaaaaguaauuacaguuuu

SEQ ID NO: 6186 - RNA, 23 nt, Homo sapiens
caaaaacugcaauuacuuuugca

SEQ ID NO: 6187 - RNA, 23 nt, Homo sapiens
ugcaaaaguaauugcgguuuuug

SEQ ID NO: 6188 - RNA, 22 nt, Homo sapiens
gacaaaaaccgcgauuacuuuu

SEQ ID NO: 6189 - RNA, 22 nt, Homo sapiens
ggcaaaauccgcaauuacuuuu

SEQ ID NO: 6190 - RNA, 22 nt, Homo sapiens
accaaagaccgcaauuacuuuu

SEQ ID NO: 6191 - RNA, 22 nt, Homo sapiens
agcaaaauccgcaaguacuuuu

SEQ ID NO: 6192 - RNA, 22 nt, Homo sapiens
gacaaaacccgcaaauacuuuu

SEQ ID NO: 6193 - RNA, 21 nt, Homo sapiens
caaaaaccacaaauaccuuug

SEQ ID NO: 6194 - RNA, 22 nt, Homo sapiens
acaaaauccacaauuacuuuug

SEQ ID NO: 6195 - RNA, 22 nt, Homo sapiens
gcaaaaguaacugcaguuuugg

SEQ ID NO: 6196 - RNA, 22 nt, Homo sapiens
ggcaaaaaccgcaauuacuuuu

SEQ ID NO: 6197 - RNA, 22 nt, Homo sapiens
aaaguaacugcaguuuuugcua

SEQ ID NO: 6198 - RNA, 22 nt, Homo sapiens
ccgccauuacuuuugcaccagc

SEQ ID NO: 6199 - RNA, 23 nt, Homo sapiens
aaaauaacugcaguuuuggccau

SEQ ID NO: 6200 - RNA, 25 nt, Homo sapiens
uggugcaaaaguaauugugguuuuu

SEQ ID NO: 6201 - RNA, 21 nt, Homo sapiens
caaaaaccacgaucacuuuug

SEQ ID NO: 6202 - RNA, 23 nt, Homo sapiens
cgcaaaaguaauugcagucuuug

SEQ ID NO: 6203 - RNA, 23 nt, Homo sapiens
aggcaaaaaccgcaguuacuuuu

SEQ ID NO: 6204 - RNA, 22 nt, Homo sapiens
ggcaaaaacagugauuacuuuu

SEQ ID NO: 6205 - RNA, 23 nt, Homo sapiens
ugcaaaaguaauugcgguuuuug

SEQ ID NO: 6206 - RNA, 21 nt, Homo sapiens
agagcucauccauaguuguca

SEQ ID NO: 6207 - RNA, 20 nt, Homo sapiens
cucuuacucccucaggcacu

SEQ ID NO: 6208 - RNA, 22 nt, Homo sapiens
augugccugagggaguaagaca

SEQ ID NO: 6209 - RNA, 23 nt, Homo sapiens
gggcucuuacucccucaggcacu

SEQ ID NO: 6210 - RNA, 22 nt, Homo sapiens
ugucuuacucccucaggcacau

SEQ ID NO: 6211 - RNA, 20 nt, Homo sapiens
cagugccugagggaguaaga

SEQ ID NO: 6212 - RNA, 21 nt, Homo sapiens
uggaaaccaagagugggucgc

SEQ ID NO: 6213 - RNA, 21 nt, Homo sapiens
cugaaaccaaguaugggucgc

SEQ ID NO: 6214 - RNA, 22 nt, Homo sapiens
ggucucacccacgcuugauuuc

SEQ ID NO: 6215 - RNA, 21 nt, Homo sapiens
uugucuaaccagucaccuguu

SEQ ID NO: 6216 - RNA, 21 nt, Homo sapiens
aaaacaaaaucucaccguuuu

SEQ ID NO: 6217 - RNA, 21 nt, Homo sapiens
acuggcugagucaggacuagc

SEQ ID NO: 6218 - RNA, 21 nt, Homo sapiens
aucagagguucagcuuacccu

SEQ ID NO: 6219 - RNA, 22 nt, Homo sapiens
aaagaugagcuaaugguaauau

SEQ ID NO: 6220 - RNA, 22 nt, Homo sapiens
cucauauuacaaugagcucauc

SEQ ID NO: 6221 - RNA, 23 nt, Homo sapiens
agacaaggcccacccgugcaaac

SEQ ID NO: 6222 - RNA, 19 nt, Homo sapiens
cagaggagccuccuaggac

SEQ ID NO: 6223 - RNA, 21 nt, Homo sapiens
gggaggcuccuuugagaauug

SEQ ID NO: 6224 - RNA, 21 nt, Homo sapiens
agcagaccccugcaccccaac

SEQ ID NO: 6225 - RNA, 22 nt, Homo sapiens
gaucugguacuccuuaagcuaa

SEQ ID NO: 6226 - RNA, 21 nt, Homo sapiens
guuagcuuaaggaguaccaua

SEQ ID NO: 6227 - RNA, 19 nt, Homo sapiens
auuuugguacagcagcuca

SEQ ID NO: 6228 - RNA, 22 nt, Homo sapiens
gugcuggcucacuucauaugug

SEQ ID NO: 6229 - RNA, 22 nt, Homo sapiens
acacauaugaaaugagccagca

SEQ ID NO: 6230 - RNA, 22 nt, Homo sapiens
ggaacuucuaggaggcauggaa

SEQ ID NO: 6231 - RNA, 22 nt, Homo sapiens
ucuccauuucuccuggaaggcu

SEQ ID NO: 6232 - RNA, 22 nt, Homo sapiens
ccuaggcacacuuaaaguuuua

SEQ ID NO: 6233 - RNA, 22 nt, Homo sapiens
gcuauaacuuuaagugugccua

SEQ ID NO: 6234 - RNA, 22 nt, Homo sapiens
ccaaacuaauauacccauauuc

SEQ ID NO: 6235 - RNA, 22 nt, Homo sapiens
cagaauauggguauauuaguuu

SEQ ID NO: 6236 - RNA, 22 nt, Homo sapiens
aauugggcaaagggaagaacua

SEQ ID NO: 6237 - RNA, 22 nt, Homo sapiens
ucuaguucuucccauuucccug

SEQ ID NO: 6238 - RNA, 22 nt, Homo sapiens
accuguagucccagcuauucag

SEQ ID NO: 6239 - RNA, 22 nt, Homo sapiens
cucucgaguagcugguacuuca

SEQ ID NO: 6240 - RNA, 22 nt, Homo sapiens
cuuuaaccagcuugucacucug

SEQ ID NO: 6241 - RNA, 22 nt, Homo sapiens
gcauauaguaacaagcuggaua

SEQ ID NO: 6242 - RNA, 21 nt, Homo sapiens
gaugaucacacugcccggggc

SEQ ID NO: 6243 - RNA, 18 nt, Homo sapiens
agucccggaggugaccau

SEQ ID NO: 6244 - RNA, 19 nt, Homo sapiens
gcuggcauuagugggacuu

SEQ ID NO: 6245 - RNA, 21 nt, Homo sapiens
aaaagucccacuaaugccagu

SEQ ID NO: 6246 - RNA, 23 nt, Homo sapiens
ugggagcuagguugccaugugca

SEQ ID NO: 6247 - RNA, 21 nt, Homo sapiens
acugcacaagagcacccagcc

SEQ ID NO: 6248 - RNA, 21 nt, Homo sapiens
uuuuggugcauauuuacuuua

SEQ ID NO: 6249 - RNA, 21 nt, Homo sapiens
uugccauacaugaacuuuauu

SEQ ID NO: 6250 - RNA, 21 nt, Homo sapiens
aauaaagucuauguauggcaa

SEQ ID NO: 6251 - RNA, 21 nt, Homo sapiens
ugggagcuaagcuauggguau

SEQ ID NO: 6252 - RNA, 21 nt, Homo sapiens
auacccauagcuuagcuccca

SEQ ID NO: 6253 - RNA, 22 nt, Homo sapiens
acuucaaggaucuuaaacuuug

SEQ ID NO: 6254 - RNA, 22 nt, Homo sapiens
ggcaaaguuuaagauccuugau

SEQ ID NO: 6255 - RNA, 20 nt, Homo sapiens
gcaaaugguacagcuacuuu

SEQ ID NO: 6256 - RNA, 19 nt, Homo sapiens
gggaaacguaugucaaccu

SEQ ID NO: 6257 - RNA, 19 nt, Homo sapiens
gccugcugacaccgugccu

SEQ ID NO: 6258 - RNA, 19 nt, Homo sapiens
guugggaucacaggcgccc

SEQ ID NO: 6259 - RNA, 23 nt, Homo sapiens
guucuguccuggaagaacauacu

SEQ ID NO: 6260 - RNA, 20 nt, Homo sapiens
guguguauacauuuauacau

SEQ ID NO: 6261 - RNA, 22 nt, Homo sapiens
gcagauuaguccagcauuucuc

SEQ ID NO: 6262 - RNA, 22 nt, Homo sapiens
aagagguauugccacccuuucu

SEQ ID NO: 6263 - RNA, 22 nt, Homo sapiens
acuagaaaggguggcaauaccu

SEQ ID NO: 6264 - RNA, 22 nt, Homo sapiens
accuuauccugcaaggugcuac

SEQ ID NO: 6265 - RNA, 24 nt, Homo sapiens
gaagucagagaaucugcaucugua

SEQ ID NO: 6266 - RNA, 20 nt, Homo sapiens
cuguugcucaggcuagaguu

SEQ ID NO: 6267 - RNA, 22 nt, Homo sapiens
cccgugauaacugcugggcugu

SEQ ID NO: 6268 - RNA, 21 nt, Homo sapiens
acaauacaauacgauacgaua

SEQ ID NO: 6269 - RNA, 22 nt, Homo sapiens
auuugacccuaaaacguucuaa

SEQ ID NO: 6270 - RNA, 22 nt, Homo sapiens
gcuguuuuacagguguuuguua

SEQ ID NO: 6271 - RNA, 22 nt, Homo sapiens
ucuaggacuacagguguaugcu

SEQ ID NO: 6272 - RNA, 21 nt, Homo sapiens
acuuuccaggauucauuaacu

SEQ ID NO: 6273 - RNA, 21 nt, Homo sapiens
ccuaauagagguaguagcuga

SEQ ID NO: 6274 - RNA, 22 nt, Homo sapiens
gcuuucucggagcucagagcaa

SEQ ID NO: 6275 - RNA, 22 nt, Homo sapiens
acacccacugugguauuauuug

SEQ ID NO: 6276 - RNA, 20 nt, Homo sapiens
acaccuacugugauauuauu

SEQ ID NO: 6277 - RNA, 22 nt, Homo sapiens
guacaccuacugugauauuauu

SEQ ID NO: 6278 - RNA, 22 nt, Homo sapiens
gaguucauuucagagccacugc

SEQ ID NO: 6279 - RNA, 21 nt, Homo sapiens
cugagacagucccaugaucug

SEQ ID NO: 6280 - RNA, 22 nt, Homo sapiens
cugucuagauucuucuuggagu

SEQ ID NO: 6281 - RNA, 22 nt, Homo sapiens
ggcaucagacuacuuaaaugag

SEQ ID NO: 6282 - RNA, 22 nt, Homo sapiens
ccuuuaucaugaaacuacuuga

SEQ ID NO: 6283 - RNA, 22 nt, Homo sapiens
ccacaaucacugcacuccccca

SEQ ID NO: 6284 - RNA, 22 nt, Homo sapiens
gcuccaacaaggaaagacagga

SEQ ID NO: 6285 - RNA, 22 nt, Homo sapiens
ccuucaauaauuuaaugcauua

SEQ ID NO: 6286 - RNA, 19 nt, Homo sapiens
aaucagaacgugacaauaa

SEQ ID NO: 6287 - RNA, 22 nt, Homo sapiens
caugggauauguugcugacuca

SEQ ID NO: 6288 - RNA, 18 nt, Homo sapiens
accuucccgacuucuccu

SEQ ID NO: 6289 - RNA, 22 nt, Homo sapiens
gcaaagguaauugcuguuuucg

SEQ ID NO: 6290 - RNA, 22 nt, Homo sapiens
gcauaaugggaugauggccuaa

SEQ ID NO: 6291 - RNA, 23 nt, Homo sapiens
cacaggccaugagccccgaaaca

SEQ ID NO: 6292 - RNA, 22 nt, Homo sapiens
gggaaaaacugcaauuaccuuu

SEQ ID NO: 6293 - RNA, 22 nt, Homo sapiens
agcuucagcauguuauccagaa

SEQ ID NO: 6294 - RNA, 22 nt, Homo sapiens
gccuuguacagcauucaaacgu

SEQ ID NO: 6295 - RNA, 20 nt, Homo sapiens
ggucaggcacagucgcucau

SEQ ID NO: 6296 - RNA, 21 nt, Homo sapiens
cucacucagauggccaacuca

SEQ ID NO: 6297 - RNA, 20 nt, Homo sapiens
ugggccaccgccgagcggac

SEQ ID NO: 6298 - RNA, 24 nt, Homo sapiens
cugaucaguuacacaucacuucag

SEQ ID NO: 6299 - RNA, 20 nt, Homo sapiens
gcuccccauucucucuccgc

SEQ ID NO: 6300 - RNA, 22 nt, Homo sapiens
ugugggugugugcaugagcgug

SEQ ID NO: 6301 - RNA, 23 nt, Homo sapiens
acacacucacacacacacacuca

SEQ ID NO: 6302 - RNA, 19 nt, Homo sapiens
gcuccuguccaacuggcuc

SEQ ID NO: 6303 - RNA, 22 nt, Homo sapiens
gauuccaauuuuuccacaucuu

SEQ ID NO: 6304 - RNA, 22 nt, Homo sapiens
aaagacguggagaaauuagaau

SEQ ID NO: 6305 - RNA, 21 nt, Homo sapiens
cagguaccaauauuuuaucua

SEQ ID NO: 6306 - RNA, 21 nt, Homo sapiens
acaauccuagagcacaagaag

SEQ ID NO: 6307 - RNA, 20 nt, Homo sapiens
accuccccgcgccccagccc

SEQ ID NO: 6308 - RNA, 23 nt, Homo sapiens
aaucgcgguuuauaccaaaugaa

SEQ ID NO: 6309 - RNA, 22 nt, Homo sapiens
ccuaaugauucaucauucucaa

SEQ ID NO: 6310 - RNA, 21 nt, Homo sapiens
acugaucuagagaacacaaga

SEQ ID NO: 6311 - RNA, 22 nt, Homo sapiens
gguucaguuguucaaccaguua

SEQ ID NO: 6312 - RNA, 23 nt, Homo sapiens
aguaacugguugaacaacuguaa

SEQ ID NO: 6313 - RNA, 21 nt, Homo sapiens
guaaugggaccuuccucuuug

SEQ ID NO: 6314 - RNA, 22 nt, Homo sapiens
agccugguuggccuggaacuga

SEQ ID NO: 6315 - RNA, 22 nt, Homo sapiens
cucagucccaggcaaaccauaa

SEQ ID NO: 6316 - RNA, 19 nt, Homo sapiens
uagcauacagauacgccca

SEQ ID NO: 6317 - RNA, 22 nt, Homo sapiens
ggaccuaaaaauacaaugcaua

SEQ ID NO: 6318 - RNA, 21 nt, Homo sapiens
gugacucaucaccuauggaaa

SEQ ID NO: 6319 - RNA, 21 nt, Homo sapiens
guucuaacccauuguggccaa

SEQ ID NO: 6320 - RNA, 24 nt, Homo sapiens
ucugggaaccggcauuuguucuga

SEQ ID NO: 6321 - RNA, 22 nt, Homo sapiens
cucagagcagacgugguucuca

SEQ ID NO: 6322 - RNA, 21 nt, Homo sapiens
acuagcuuauacauaaaauua

SEQ ID NO: 6323 - RNA, 22 nt, Homo sapiens
cugcacuuuuaugaauaagcuc

SEQ ID NO: 6324 - RNA, 20 nt, Homo sapiens
acaaugagaacccauggucu

SEQ ID NO: 6325 - RNA, 22 nt, Homo sapiens
acaucaucgcauauugacacaa

SEQ ID NO: 6326 - RNA, 19 nt, Homo sapiens
agaaaccccagcagagaca

SEQ ID NO: 6327 - RNA, 25 nt, Homo sapiens
gcugagcaaugccuggcuggugccu

SEQ ID NO: 6328 - RNA, 21 nt, Homo sapiens
agacacaccacggcacacuuc

SEQ ID NO: 6329 - RNA, 21 nt, Homo sapiens
cccgaggagccgggcaggcuu

SEQ ID NO: 6330 - RNA, 22 nt, Homo sapiens
acaguggucaucgagugacaca

SEQ ID NO: 6331 - RNA, 22 nt, Homo sapiens
ugacgaugacaacgaugacgua

SEQ ID NO: 6332 - RNA, 20 nt, Homo sapiens
guuugauaaacugacacaac

SEQ ID NO: 6333 - RNA, 23 nt, Homo sapiens
gagcaaggcucuugucuguaagu

SEQ ID NO: 6334 - RNA, 22 nt, Homo sapiens
cuccuccaacaauccuagacca

SEQ ID NO: 6335 - RNA, 23 nt, Homo sapiens
gggccgcagcugucgcccguguc

SEQ ID NO: 6336 - RNA, 22 nt, Homo sapiens
gcaaaaguaauugcagugugug

SEQ ID NO: 6337 - RNA, 19 nt, Homo sapiens
guccugaauuccgcagccu

SEQ ID NO: 6338 - RNA, 23 nt, Homo sapiens
aggagaaggcaccaugggauuua

SEQ ID NO: 6339 - RNA, 21 nt, Homo sapiens
aucuuugauuuucaguaguuu

SEQ ID NO: 6340 - RNA, 21 nt, Homo sapiens
ccaccgccggagacucgcagg

SEQ ID NO: 6341 - RNA, 21 nt, Homo sapiens
gggggcagcaggcccuagccc

SEQ ID NO: 6342 - RNA, 21 nt, Homo sapiens
guuauagaucuggauuugaac

SEQ ID NO: 6343 - RNA, 19 nt, Homo sapiens
cuccagggacuggaaccgg

SEQ ID NO: 6344 - RNA, 19 nt, Homo sapiens
gccuuggccggcagcagaa

SEQ ID NO: 6345 - RNA, 22 nt, Homo sapiens
cuaaggugcagugugaugagga

SEQ ID NO: 6346 - RNA, 20 nt, Homo sapiens
guagcugauaacucacuacc

SEQ ID NO: 6347 - RNA, 20 nt, Homo sapiens
ccaccuagccucugaauauc

SEQ ID NO: 6348 - RNA, 21 nt, Homo sapiens
caccaaugccgccugggccgu

SEQ ID NO: 6349 - RNA, 21 nt, Homo sapiens
ccaccucuccucugucaugcu

SEQ ID NO: 6350 - RNA, 21 nt, Homo sapiens
gaaggccguacagcucuuccc

SEQ ID NO: 6351 - RNA, 19 nt, Homo sapiens
ccacagcuagcucaggcgg

SEQ ID NO: 6352 - RNA, 24 nt, Homo sapiens
cagcuaguugguccaagcuuccaa

SEQ ID NO: 6353 - RNA, 25 nt, Homo sapiens
acggagcugucccaacaccaccccu

SEQ ID NO: 6354 - RNA, 19 nt, Homo sapiens
cgggaacgcccgcacuaga

SEQ ID NO: 6355 - RNA, 24 nt, Homo sapiens
ggcgccuuggccggcacugcuccu

SEQ ID NO: 6356 - RNA, 19 nt, Homo sapiens
ggaucaaccagacguauuc

SEQ ID NO: 6357 - RNA, 20 nt, Homo sapiens
cccacagccucugauauaag

SEQ ID NO: 6358 - RNA, 20 nt, Homo sapiens
ccggccaccgacuggcggaa

SEQ ID NO: 6359 - RNA, 19 nt, Homo sapiens
ugugcucccccagccccuu

SEQ ID NO: 6360 - RNA, 20 nt, Homo sapiens
cucugcccuucccaaccucc

SEQ ID NO: 6361 - RNA, 18 nt, Homo sapiens
gcucgcccccccgccuca

SEQ ID NO: 6362 - RNA, 20 nt, Homo sapiens
cgcccccccgcuucaucucu

SEQ ID NO: 6363 - RNA, 24 nt, Homo sapiens
ccgccccgccccaccccggccucc

SEQ ID NO: 6364 - RNA, 20 nt, Homo sapiens
agagaugagagaaacacccu

SEQ ID NO: 6365 - RNA, 19 nt, Homo sapiens
gccccgccccucgcucccc

SEQ ID NO: 6366 - RNA, 21 nt, Homo sapiens
ucccagcacacauuuagcuca

SEQ ID NO: 6367 - RNA, 23 nt, Homo sapiens
gucagaccccgagggguccucgc

SEQ ID NO: 6368 - RNA, 25 nt, Homo sapiens
aaggagcucagaagcccugcccagc

SEQ ID NO: 6369 - RNA, 20 nt, Homo sapiens
uccucccccuuccuuuuccc

SEQ ID NO: 6370 - RNA, 20 nt, Homo sapiens
uccgccgcuccgccuuccgc

SEQ ID NO: 6371 - RNA, 18 nt, Homo sapiens
ucuccgccgggccuucac

SEQ ID NO: 6372 - RNA, 19 nt, Homo sapiens
ccucccacccacucccuca

SEQ ID NO: 6373 - RNA, 19 nt, Homo sapiens
uuuugacuccaauuccagu

SEQ ID NO: 6374 - RNA, 19 nt, Homo sapiens
uauacacccaacucccuca

SEQ ID NO: 6375 - RNA, 20 nt, Homo sapiens
ggcaaagaaggaacauuccu

SEQ ID NO: 6376 - RNA, 19 nt, Homo sapiens
cauacaauccacucccuca

SEQ ID NO: 6377 - RNA, 19 nt, Homo sapiens
cacucccaucugaccagcc

SEQ ID NO: 6378 - RNA, 19 nt, Homo sapiens
ugcaauccccagcccugcu

SEQ ID NO: 6379 - RNA, 19 nt, Homo sapiens
uacccaaccuccucccuca

SEQ ID NO: 6380 - RNA, 19 nt, Homo sapiens
ucuacauccuaccaccuca

SEQ ID NO: 6381 - RNA, 23 nt, Homo sapiens
ccaccuggcaagaacaggcguuc

SEQ ID NO: 6382 - RNA, 22 nt, Homo sapiens
aagagggagacccaggcucgga

SEQ ID NO: 6383 - RNA, 22 nt, Homo sapiens
gauccgagcaccggggaccccc

SEQ ID NO: 6384 - RNA, 22 nt, Homo sapiens
cugcucaaacccuccaaugacu

SEQ ID NO: 6385 - RNA, 19 nt, Homo sapiens
cuccccucaccuccugcug

SEQ ID NO: 6386 - RNA, 22 nt, Homo sapiens
aagucacugaaggguuuugagu

SEQ ID NO: 6387 - RNA, 22 nt, Homo sapiens
gccaccuucaaaugggaagucu

SEQ ID NO: 6388 - RNA, 23 nt, Homo sapiens
acucagaaggacaaguagaguuu

SEQ ID NO: 6389 - RNA, 24 nt, Homo sapiens
acugggcacaaacauguccagguc

SEQ ID NO: 6390 - RNA, 20 nt, Homo sapiens
auuucuauaucuaucuccau

SEQ ID NO: 6391 - RNA, 21 nt, Homo sapiens
agguaagcgcuguugcuagcc

SEQ ID NO: 6392 - RNA, 21 nt, Homo sapiens
gcuccaaccucagcagacugu

SEQ ID NO: 6393 - RNA, 23 nt, Homo sapiens
acccaacagccccugcaagggau

SEQ ID NO: 6394 - RNA, 21 nt, Homo sapiens
agguaauaccaauaccuugug

SEQ ID NO: 6395 - RNA, 22 nt, Homo sapiens
ugaacacaagguacugguacua

SEQ ID NO: 6396 - RNA, 22 nt, Homo sapiens
ugagggggaaaguucuauaguc

SEQ ID NO: 6397 - RNA, 21 nt, Homo sapiens
ggacuauagaacuuucccccu

SEQ ID NO: 6398 - RNA, 19 nt, Homo sapiens
aagacauuuucagacagcu

SEQ ID NO: 6399 - RNA, 22 nt, Homo sapiens
uccucuuuucuuagagacucac

SEQ ID NO: 6400 - RNA, 21 nt, Homo sapiens
ucgacugccacucuuacuaga

SEQ ID NO: 6401 - RNA, 22 nt, Homo sapiens
ccucuaguaaauaugucagcau

SEQ ID NO: 6402 - RNA, 22 nt, Homo sapiens
gcugggcuuacguugggagaac

SEQ ID NO: 6403 - RNA, 21 nt, Homo sapiens
aguucucccaacguaaaccca

SEQ ID NO: 6404 - RNA, 22 nt, Homo sapiens
accuucccugguacagaauacu

SEQ ID NO: 6405 - RNA, 21 nt, Homo sapiens
gcugaggucugggccaggucu

SEQ ID NO: 6406 - RNA, 19 nt, Homo sapiens
ucccacaggaagcagacac

SEQ ID NO: 6407 - RNA, 23 nt, Homo sapiens
uuuauugugguagauacuauuag

SEQ ID NO: 6408 - RNA, 22 nt, Homo sapiens
guccaaaguuggggugcugguu

SEQ ID NO: 6409 - RNA, 23 nt, Homo sapiens
ggacauuguuucagugcccaagu

SEQ ID NO: 6410 - RNA, 23 nt, Homo sapiens
ugcgggcgggacgagcaagcaca

SEQ ID NO: 6411 - RNA, 24 nt, Homo sapiens
acgcagagcccgaaagcccccagu

SEQ ID NO: 6412 - RNA, 25 nt, Homo sapiens
aggccgccacccgcccgcgaucccu

SEQ ID NO: 6413 - RNA, 23 nt, Homo sapiens
acagcgcucgcaaccgcagcgau

SEQ ID NO: 6414 - RNA, 21 nt, Homo sapiens
agaggcagguuccuggaucau

SEQ ID NO: 6415 - RNA, 24 nt, Homo sapiens
gaggugacucuauccuaugucuuu

SEQ ID NO: 6416 - RNA, 22 nt, Homo sapiens
gguucccucuccaaaugugucu

SEQ ID NO: 6417 - RNA, 22 nt, Homo sapiens
caagacacauuuggagagggac

SEQ ID NO: 6418 - RNA, 22 nt, Homo sapiens
gggucccucuccaaaugugucu

SEQ ID NO: 6419 - RNA, 22 nt, Homo sapiens
agacacauuuggagagggaacc

SEQ ID NO: 6420 - RNA, 22 nt, Homo sapiens
cuaccugagcuagcauacaagu

SEQ ID NO: 6421 - RNA, 19 nt, Homo sapiens
gcucuaagaaagccacacu

SEQ ID NO: 6422 - RNA, 19 nt, Homo sapiens
ucagcaguaccagccuaga

SEQ ID NO: 6423 - RNA, 19 nt, Homo sapiens
gccucagaggcagcugcuu

SEQ ID NO: 6424 - RNA, 21 nt, Homo sapiens
gaaggaagugagugcagccac

SEQ ID NO: 6425 - RNA, 19 nt, Homo sapiens
accagugcccugcacacuu

SEQ ID NO: 6426 - RNA, 22 nt, Homo sapiens
gacucuugaacaacacagguuu

SEQ ID NO: 6427 - RNA, 22 nt, Homo sapiens
ugugggcaaaacaaacacugcu

SEQ ID NO: 6428 - RNA, 22 nt, Homo sapiens
acugcagugcucuugcgcccga

SEQ ID NO: 6429 - RNA, 21 nt, Homo sapiens
guccugagagcgcugccuccu

SEQ ID NO: 6430 - RNA, 21 nt, Homo sapiens
gcaggucaucccaacaagugu

SEQ ID NO: 6431 - RNA, 24 nt, Homo sapiens
ggacaccuggaguggauagcuccu

SEQ ID NO: 6432 - RNA, 23 nt, Homo sapiens
acuguuaccgcaggcugcucugg

SEQ ID NO: 6433 - RNA, 22 nt, Homo sapiens
accaaaggcagcccuggcaacu

SEQ ID NO: 6434 - RNA, 21 nt, Homo sapiens
auacucuagaaagauggucua

SEQ ID NO: 6435 - RNA, 22 nt, Homo sapiens
ggucaacaaucuuucuagagcu

SEQ ID NO: 6436 - RNA, 21 nt, Homo sapiens
ggaggucugcauccuaguccc

SEQ ID NO: 6437 - RNA, 23 nt, Homo sapiens
ucuggggauuugaaugcagaccu

SEQ ID NO: 6438 - RNA, 20 nt, Homo sapiens
agaauggcugugcuguaaug

SEQ ID NO: 6439 - RNA, 21 nt, Homo sapiens
cugcauuacagcacagccaga

SEQ ID NO: 6440 - RNA, 21 nt, Homo sapiens
cuuuggaagagguagaaguca

SEQ ID NO: 6441 - RNA, 22 nt, Homo sapiens
gcugagauauccccuauuccaa

SEQ ID NO: 6442 - RNA, 22 nt, Homo sapiens
gugucuggaaucucugauacga

SEQ ID NO: 6443 - RNA, 23 nt, Homo sapiens
accauauucagugacaucccagu

SEQ ID NO: 6444 - RNA, 22 nt, Homo sapiens
gggaaaaauaggaaggacuuug

SEQ ID NO: 6445 - RNA, 21 nt, Homo sapiens
acaaagucccuccuauucuuc

SEQ ID NO: 6446 - RNA, 22 nt, Homo sapiens
aguucuagaaaugcauggccca

SEQ ID NO: 6447 - RNA, 21 nt, Homo sapiens
ggugggucaugcauuucuaga

SEQ ID NO: 6448 - RNA, 22 nt, Homo sapiens
aaauuagguaguggcaguggaa

SEQ ID NO: 6449 - RNA, 21 nt, Homo sapiens
guuccacugccacuaccuaau

SEQ ID NO: 6450 - RNA, 22 nt, Homo sapiens
caaaagucaagcuuauccuaaa

SEQ ID NO: 6451 - RNA, 21 nt, Homo sapiens
cugcaggagacagagucggug

SEQ ID NO: 6452 - RNA, 22 nt, Homo sapiens
gacuccucucucuccccugcug

SEQ ID NO: 6453 - RNA, 22 nt, Homo sapiens
gcaggcagaagggauggugagg

SEQ ID NO: 6454 - RNA, 23 nt, Homo sapiens
ccugucagccccacuucugccug

SEQ ID NO: 6455 - RNA, 23 nt, Homo sapiens
ugcaggcagaagggguggugagg

SEQ ID NO: 6456 - RNA, 24 nt, Homo sapiens
ugucagccccacuucugccugcag

SEQ ID NO: 6457 - RNA, 22 nt, Homo sapiens
ccuaccauuagaagggcuggaa

SEQ ID NO: 6458 - RNA, 22 nt, Homo sapiens
ucuuccagcucuucuaauggua

SEQ ID NO: 6459 - RNA, 21 nt, Homo sapiens
cuagggacagaugacacuuga

SEQ ID NO: 6460 - RNA, 23 nt, Homo sapiens
agacauguggcgucaaucccaaa

SEQ ID NO: 6461 - RNA, 21 nt, Homo sapiens
cuggaguggaagaacaggcag

SEQ ID NO: 6462 - RNA, 23 nt, Homo sapiens
gccagcugaaaguccacuccaua

SEQ ID NO: 6463 - RNA, 20 nt, Homo sapiens
cugggggguagaugaagaga

SEQ ID NO: 6464 - RNA, 21 nt, Homo sapiens
gaugucuuccacacccuccaa

SEQ ID NO: 6465 - RNA, 21 nt, Homo sapiens
cacaacccuaguggcgccauu

SEQ ID NO: 6466 - RNA, 25 nt, Homo sapiens
ugaauggcacccucuccuaggguug

SEQ ID NO: 6467 - RNA, 21 nt, Homo sapiens
caguagagauuguuucaacac

SEQ ID NO: 6468 - RNA, 22 nt, Homo sapiens
aaggugauggucagcagacaua

SEQ ID NO: 6469 - RNA, 22 nt, Homo sapiens
gcacauguucugcggcccacca

SEQ ID NO: 6470 - RNA, 22 nt, Homo sapiens
aaagagguuaaccauguauuau

SEQ ID NO: 6471 - RNA, 21 nt, Homo sapiens
agagguugacuguauaauauu

SEQ ID NO: 6472 - RNA, 23 nt, Homo sapiens
ccuagagagggugagaaccugcc

SEQ ID NO: 6473 - RNA, 25 nt, Homo sapiens
accaacggaccuacuucccuccgcc

SEQ ID NO: 6474 - RNA, 22 nt, Homo sapiens
uggggacccucccugaaccaag

SEQ ID NO: 6475 - RNA, 22 nt, Homo sapiens
uccuugguucagggaagguccu

SEQ ID NO: 6476 - RNA, 21 nt, Homo sapiens
uaauccaugcacacaggaggu

SEQ ID NO: 6477 - RNA, 22 nt, Homo sapiens
caacuccgauaugcaaugggua

SEQ ID NO: 6478 - RNA, 24 nt, Homo sapiens
acgcgcaggccagagacccaggca

SEQ ID NO: 6479 - RNA, 21 nt, Homo sapiens
cugcugggccacaacguggga

SEQ ID NO: 6480 - RNA, 22 nt, Homo sapiens
gcggucccgcggcgccccgccu

SEQ ID NO: 6481 - RNA, 22 nt, Homo sapiens
ccucaggcacggccgggccacc

SEQ ID NO: 6482 - RNA, 23 nt, Homo sapiens
uguaggcuggggauaaaugaaua

SEQ ID NO: 6483 - RNA, 24 nt, Homo sapiens
auccaaucauuuucccuagccagu

SEQ ID NO: 6484 - RNA, 22 nt, Homo sapiens
uguaggcugggaggcaaaugaa

SEQ ID NO: 6485 - RNA, 24 nt, Homo sapiens
uacccaaucaucucccuuagccca

SEQ ID NO: 6486 - RNA, 20 nt, Homo sapiens
aggggccucagccuccuggu

SEQ ID NO: 6487 - RNA, 23 nt, Homo sapiens
guagugggccgagccgagugaca

SEQ ID NO: 6488 - RNA, 20 nt, Homo sapiens
caccacauacacucagggac

SEQ ID NO: 6489 - RNA, 21 nt, Homo sapiens
gguggagcccugagaaccgga

SEQ ID NO: 6490 - RNA, 21 nt, Homo sapiens
ccacaggcacgacugguuugg

SEQ ID NO: 6491 - RNA, 22 nt, Homo sapiens
ccacaggcacagccgguuugag

SEQ ID NO: 6492 - RNA, 21 nt, Homo sapiens
ugccaaaccagucgugccugu

SEQ ID NO: 6493 - RNA, 23 nt, Homo sapiens
cuccagccccuccagggcuuccu

SEQ ID NO: 6494 - RNA, 22 nt, Homo sapiens
gcagaggaauggagaguucgga

SEQ ID NO: 6495 - RNA, 20 nt, Homo sapiens
ggcccuuacccccauuccca

SEQ ID NO: 6496 - RNA, 22 nt, Homo sapiens
ucucuacauccccacaucgccu

SEQ ID NO: 6497 - RNA, 21 nt, Homo sapiens
ucauaagcccucugaccacua

SEQ ID NO: 6498 - RNA, 22 nt, Homo sapiens
caggagaaucacugaugucaga

SEQ ID NO: 6499 - RNA, 22 nt, Homo sapiens
ucuaccaguuccugcaggcgcg

SEQ ID NO: 6500 - RNA, 23 nt, Homo sapiens
cuccuacaauaagccccugccca

SEQ ID NO: 6501 - RNA, 22 nt, Homo sapiens
ccuggcccacccgaccccugca

SEQ ID NO: 6502 - RNA, 20 nt, Homo sapiens
gcauguggucgggugcgccu

SEQ ID NO: 6503 - RNA, 22 nt, Homo sapiens
gccccgacguuacucggacuau

SEQ ID NO: 6504 - RNA, 23 nt, Homo sapiens
ccccacgcccgccgcgggcccag

SEQ ID NO: 6505 - RNA, 20 nt, Homo sapiens
ugagcggugagggcauacag

SEQ ID NO: 6506 - RNA, 23 nt, Homo sapiens
cacugugggcccucuccgcacca

SEQ ID NO: 6507 - RNA, 21 nt, Homo sapiens
aacucaacaaccuuaggacag

SEQ ID NO: 6508 - RNA, 21 nt, Homo sapiens
ugcaaguccugagguugaaga

SEQ ID NO: 6509 - RNA, 22 nt, Homo sapiens
cuagaagcucacagucuaguug

SEQ ID NO: 6510 - RNA, 23 nt, Homo sapiens
cccagcuagauuguaagcuccuu

SEQ ID NO: 6511 - RNA, 22 nt, Homo sapiens
cuuacgucucucccuggguccc

SEQ ID NO: 6512 - RNA, 22 nt, Homo sapiens
uauggcagacugugauuuguug

SEQ ID NO: 6513 - RNA, 21 nt, Homo sapiens
cgacgcccggcggggcggaag

SEQ ID NO: 6514 - RNA, 22 nt, Homo sapiens
uuagguagacugggauuuguug

SEQ ID NO: 6515 - RNA, 22 nt, Homo sapiens
agguugagguuaguggcaacag

SEQ ID NO: 6516 - RNA, 22 nt, Homo sapiens
ugcuguuagcccuagccccgca

SEQ ID NO: 6517 - RNA, 22 nt, Homo sapiens
gguuaguggaccaggucacaaa

SEQ ID NO: 6518 - RNA, 22 nt, Homo sapiens
gugugcucucuggucaaccauc

SEQ ID NO: 6519 - RNA, 22 nt, Homo sapiens
gucaaaauuguuugcacucugc

SEQ ID NO: 6520 - RNA, 23 nt, Homo sapiens
acaacaaaaucacuagucuucca

SEQ ID NO: 6521 - RNA, 20 nt, Homo sapiens
uccccacagacccagagccg

SEQ ID NO: 6522 - RNA, 22 nt, Homo sapiens
ugugucaguuucacccugcugc

SEQ ID NO: 6523 - RNA, 22 nt, Homo sapiens
gcucggccccggccccagcccc

SEQ ID NO: 6524 - RNA, 22 nt, Homo sapiens
aggaggacaagugagcaccugc

SEQ ID NO: 6525 - RNA, 21 nt, Homo sapiens
caucaccuuccuucuccucca

SEQ ID NO: 6526 - RNA, 22 nt, Homo sapiens
gcugaggcuguggggcuggagu

SEQ ID NO: 6527 - RNA, 22 nt, Homo sapiens
aagaccagcaccaauuccuccu

SEQ ID NO: 6528 - RNA, 23 nt, Homo sapiens
agaaaccaugggguaugagcaga

SEQ ID NO: 6529 - RNA, 23 nt, Homo sapiens
caugcucagacaaccauggugca

SEQ ID NO: 6530 - RNA, 23 nt, Homo sapiens
aaccaagaccccggagaucccag

SEQ ID NO: 6531 - RNA, 22 nt, Homo sapiens
agcucagaacccagaggucuca

SEQ ID NO: 6532 - RNA, 23 nt, Homo sapiens
uggcccugacacgugguacugga

SEQ ID NO: 6533 - RNA, 23 nt, Homo sapiens
acaaggaugaaucuuuguuacug

SEQ ID NO: 6534 - RNA, 22 nt, Homo sapiens
ucccgggaacucaucagucucc

SEQ ID NO: 6535 - RNA, 21 nt, Homo sapiens
aggagacucacaaguuccugc

SEQ ID NO: 6536 - RNA, 22 nt, Homo sapiens
ucggucccucgggccagggcag

SEQ ID NO: 6537 - RNA, 21 nt, Homo sapiens
cacaaccucaguguuuccagg

SEQ ID NO: 6538 - RNA, 22 nt, Homo sapiens
caccugauaaaacugagguaua

SEQ ID NO: 6539 - RNA, 22 nt, Homo sapiens
ugaauuacuuuguaaaccacca

SEQ ID NO: 6540 - RNA, 22 nt, Homo sapiens
uggugauucacaaagaaaucca

SEQ ID NO: 6541 - RNA, 21 nt, Homo sapiens
cugggaggagggagaagagga

SEQ ID NO: 6542 - RNA, 20 nt, Homo sapiens
cccugcgccaucuccucuac

SEQ ID NO: 6543 - RNA, 22 nt, Homo sapiens
uauccacuacaccccgcugccu

SEQ ID NO: 6544 - RNA, 22 nt, Homo sapiens
agaggcaggguaguguaaugga

SEQ ID NO: 6545 - RNA, 22 nt, Homo sapiens
ccucgggauggcgcccguucac

SEQ ID NO: 6546 - RNA, 22 nt, Homo sapiens
uucacccaaagaggugucaguc

SEQ ID NO: 6547 - RNA, 21 nt, Homo sapiens
ugacugacagcuuuuugagua

SEQ ID NO: 6548 - RNA, 21 nt, Homo sapiens
acaaugguuguccgauauuaa

SEQ ID NO: 6549 - RNA, 21 nt, Homo sapiens
caacugaugccuuuccaagua

SEQ ID NO: 6550 - RNA, 22 nt, Homo sapiens
ucaguggcucagguucguugca

SEQ ID NO: 6551 - RNA, 22 nt, Homo sapiens
ucaaugacucagguaaguugca

SEQ ID NO: 6552 - RNA, 21 nt, Homo sapiens
cuacgcagaaaggacacagug

SEQ ID NO: 6553 - RNA, 22 nt, Homo sapiens
ucuacccagaaaggagccagug

SEQ ID NO: 6554 - RNA, 22 nt, Homo sapiens
uccacucagaaaggaaacagug

SEQ ID NO: 6555 - RNA, 21 nt, Homo sapiens
ugacuggcaccuuucugaaua

SEQ ID NO: 6556 - RNA, 20 nt, Homo sapiens
uacugcuuccacagcucccc

SEQ ID NO: 6557 - RNA, 25 nt, Homo sapiens
gaauccugguucugucccucacuag

SEQ ID NO: 6558 - RNA, 23 nt, Homo sapiens
gacguaguccuauucucugcugc

SEQ ID NO: 6559 - RNA, 20 nt, Homo sapiens
gcaagacaucacaagacucu

SEQ ID NO: 6560 - RNA, 23 nt, Homo sapiens
agcauugcaaccgaucccaaccu

SEQ ID NO: 6561 - RNA, 22 nt, Homo sapiens
guaaugcaacaaauccccaccc

SEQ ID NO: 6562 - RNA, 22 nt, Homo sapiens
acaggccgggacaagugcaaua

SEQ ID NO: 6563 - RNA, 22 nt, Homo sapiens
ggaggccgggacgagugcaaua

SEQ ID NO: 6564 - RNA, 22 nt, Homo sapiens
cacugcaccgcgucccgucccu

SEQ ID NO: 6565 - RNA, 22 nt, Homo sapiens
gggagaggucucccugcgcaca

SEQ ID NO: 6566 - RNA, 22 nt, Homo sapiens
cgggaagugcuagcucagcagu

SEQ ID NO: 6567 - RNA, 22 nt, Homo sapiens
ccagugucuccaguaguagaca

SEQ ID NO: 6568 - RNA, 23 nt, Homo sapiens
gcgguagcggaagcgguaacugg

SEQ ID NO: 6569 - RNA, 23 nt, Homo sapiens
cuaccugcacgaacagcacuuug

SEQ ID NO: 6570 - RNA, 22 nt, Homo sapiens
cugcgauuccucccucuacugu

SEQ ID NO: 6571 - RNA, 22 nt, Homo sapiens
ggcagagagucagagcgcggau

SEQ ID NO: 6572 - RNA, 20 nt, Homo sapiens
ccagccccacccugacucac

SEQ ID NO: 6573 - RNA, 22 nt, Homo sapiens
acuggguucaccuuuaagggca

SEQ ID NO: 6574 - RNA, 21 nt, Homo sapiens
cuggggagcagaggcccaggg

SEQ ID NO: 6575 - RNA, 24 nt, Homo sapiens
cacccccagagccucagcucccca

SEQ ID NO: 6576 - RNA, 22 nt, Homo sapiens
acuuucgguuaucuagcuuuau

SEQ ID NO: 6577 - RNA, 21 nt, Homo sapiens
ggggagcgggggcccugccuu

SEQ ID NO: 6578 - RNA, 23 nt, Homo sapiens
gcacaugugcacacagccgggug

SEQ ID NO: 6579 - RNA, 22 nt, Homo sapiens
cacauggccaaaacagagaaga

SEQ ID NO: 6580 - RNA, 21 nt, Homo sapiens
cuggaggacggcaacagucag

SEQ ID NO: 6581 - RNA, 22 nt, Homo sapiens
cucauccgauguacaauaauuu

SEQ ID NO: 6582 - RNA, 22 nt, Homo sapiens
ugcucaauaaauacccguugaa

SEQ ID NO: 6583 - RNA, 23 nt, Homo sapiens
ucauacagcuagauaaccaaaga

SEQ ID NO: 6584 - RNA, 22 nt, Homo sapiens
cauauuggcacugcacaugauu

SEQ ID NO: 6585 - RNA, 23 nt, Homo sapiens
agcaaaaaugugcuagugccaaa

SEQ ID NO: 6586 - RNA, 22 nt, Homo sapiens
gggaaaguaguaaguuguauag

SEQ ID NO: 6587 - RNA, 22 nt, Homo sapiens
aacaauacaacuuacuaccuca

SEQ ID NO: 6588 - RNA, 22 nt, Homo sapiens
cagacccauagaagcgagcuug

SEQ ID NO: 6589 - RNA, 22 nt, Homo sapiens
cacaagaucggaucuacggguu

SEQ ID NO: 6590 - RNA, 22 nt, Homo sapiens
cggacccacagacacgagcuug

SEQ ID NO: 6591 - RNA, 22 nt, Homo sapiens
cgcaaggucgguucuacgggug

SEQ ID NO: 6592 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 6593 - DNA, 800 bp, Artificial Sequence
  Description of Artificial Sequence: Synthetic Transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 6594 - DNA, 800 bp, Artificial Sequence
  Description of Artificial Sequence: Synthetic Transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 6595 - RNA, 758 nt, Artificial Sequence
  Description of Artificial Sequence: Synthetic Transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 6596 - protein, 9 aa, Homo sapiens
PVAIIELEL

SEQ ID NO: 6597 - protein, 10 aa, Homo sapiens
VNQILKTLSE

SEQ ID NO: 6598 - protein, 7 aa, Homo sapiens
PKKKRKV

SEQ ID NO: 6599 - RNA, 780 nt, Artificial Sequence
  Description of Artificial Sequence: Synthetic Transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucucaaacaccauugucacacuccauggucuuugaauaaagccugaguaggaag

SEQ ID NO: 6600 - RNA, 780 nt, Artificial Sequence; identical to SEQ ID NO: 6599
  Description of Artificial Sequence: Synthetic Transcript sequence

SEQ ID NO: 6601 - RNA, 818 nt, Artificial Sequence
  Description of Artificial Sequence: Synthetic Transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucucaaacaccauugucacaaacaccauugucacaaacaccauugucacaaacaccauugucauggucuuugaauaaagccugaguaggaag

SEQ ID NO: 6602 - RNA, 854 nt, Artificial Sequence
  Description of Artificial Sequence: Synthetic Transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 6603 - DNA, 896 bp, Artificial Sequence
  Description of Artificial Sequence: Synthetic Transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 6604 - RNA, 851 nt, Artificial Sequence
  Description of Artificial Sequence: Synthetic Transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 6605 - DNA, 5160 bp, Homo sapiens
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatccta

SEQ ID NO: 6606 - DNA, 3737 bp, Homo sapiens
tgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaat

SEQ ID NO: 6607 - DNA, 2696 bp, Homo sapiens
cccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaa

SEQ ID NO: 6608 - DNA, 1143 bp, Homo sapiens
ggatcccgcggcgtccggcccgggtggtctggatcgcggagggaatgccccggagggcggagaactgggacgaggccgaggtaggcgcggaggaggcaggcgtcgaagagtacggccctgaagaagacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgtt

SEQ ID NO: 6609 - DNA, 3468 bp, Homo sapiens
atttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaagg

SEQ ID NO: 6610 - DNA, 3922 bp, Homo sapiens
gacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaataggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 6611 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 6612 - protein, 213 aa, Homo sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 6613 - protein, 172 aa, Homo sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRVYTLKERCLQVVRSLVKPENYRRLDIVRSLYEDLEDHPNVQKDLERLTQERIAHQRMGD

SEQ ID NO: 6614 - protein, 131 aa, Homo sapiens
MPRRAENWDEAEVGAEEAGVEEYGPEEDSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 6615 - protein, 767 aa, Homo sapiens [sequence omitted]

SEQ ID NO: 6616 - protein, 827 aa, Homo sapiens
MEGAGGANDKKNRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 6617 - RNA, 949 nt, Artificial Sequence
  Description of Artificial Sequence: Synthetic Transcript sequence
gggaaauaagagagaaaagaagaguaagaagaaauauaagagccaccauggaaaaagucagacgagaggggguuaaggugaugcccaaugcuauugugcaauccguuggagucagcaguggcaaguuacuuaucaagcugaaagacggcaggaagguagaaacugaccacauaguggcagcugugggccuggagcccaauguugaguuggccaagacugguggccuggaaauagacucagauuuugguggcuuccggguaaaugcagagcuacaagcacgcucuaacaucuggguggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucuggagugauuugggccccgauguuggcuaugaagcuauuggucuuguggacaguaguuugcccacaguugguguuuuugcaaaagcaacugcacaagacaaccccaaaucugccacagagcagucaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagaucauuaaggacggugagcagcaugaagaucucaaugaaguagccaaacuauucaacauucaugaagacugauaauaggcuggagccucgguggccaugcuucuugccccuugggccuccccccagccccuccuccccuuccugcacccguacccccguggucuuugaauaaagucugagugggcggc

SEQ ID NO: 6618 - RNA, 1012 nt, Artificial Sequence
  Description of Artificial Sequence: Synthetic Transcript sequence
gggaaauaagagagaaaagaagaguaagaagaaauauaagagccaccaugagccgucagacugcuacagcauuaccuaccgguaccucgaaguguccaccaucccagagggugccugcccugacuggcacaacugcauccaacaaugacuuggcgagucuuuuugaguguccagucugcuuugacuauguguuaccgcccauucuucaaugucagaguggccaucuuguuuguagcaacugucgcccaaagcucacauguuguccaacuugccggggcccuuugggauccauucgcaacuuggcuauggagaaaguggcuaauucaguacuuuuccccuguaaauaugcgucuucuggaugugaaauaacucugccacacacagaaaaagcagaccaugaagagcucugugaguuuaggccuuauuccuguccgugcccuggugcuuccuguaaauggcaaggcucucuggaugcuguaaugccccaucugaugcaucagcauaaguccauuacaacccuacagggagaggauauaguuuuucuugcuacagacauuaaucuuccuggugcuguugacugggugaugaugcaguccuguuuuggcuuucacuucauguuagucuuagagaaacaggaaaaauacgauggucaccagcaguucuucgcaaucguacagcugauaggaacacgcaagcaagcugaaaauuuugcuuaccgacuugagcuaaauggucauaggcgacgauugacuugggaagcgacuccucgaucuauucaugaaggaauugcaacagccauuaugaauagcgacugucuagucuuugacaccagcauugcacagcuuuuugcagaaaauggcaauuuaggcaucaauguaacuauuuccauguguugauaauaggcuggagccucgguggccaugcuucuugccccuugggccuccccccagccccuccuccccuuccugcacccguacccccguggucuuugaauaaagucugagugggcggc

SEQ ID NO: 6619 - RNA, 1036 nt, Artificial Sequence
  Description of Artificial Sequence: Synthetic Transcript sequence
gggaaauaagagagaaaagaagaguaagaagaaauauaagagccaccaugauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacgaugaaguugaugggggaucccccauggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaagagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacugauaauaggcuggagccucgguggccaugcuucuugccccuugggccuccccccagccccuccuccccuuccugcacccguacccccguggucuuugaauaaagucugagugggcggc

SEQ ID NO: 6620 - RNA, 601 nt, Artificial Sequence
  Description of Artificial Sequence: Synthetic Transcript sequence
gggaaauaagagagaaaagaagaguaagaagaaauauaagagccaccauggcaacuugggcccugcugcuucuugcagccauguugcucggaaauccuggucugguguuuucgcgccuuucaccggaguacuacgaucucgcucgcgcacaucugcgcgacgaggagaagucgugcccaugucucgcacaagaagggccacagggugaccuuuugaccaagacgcaagaacuuggcagggacuaccgaaccugucugaccaucgugcaaaagcugaagaaaauggucgauaaaccuacccaaagaagcguguccaacgcagcgacucgggugugccggacuggcagauccagauggcgggauguguguagaaacuucaugagaagguaccagagccguguuacucagggacuggucgcgggagaaacugcccaacagauuugcgaagaucugcgacucuguauuccuucaaccggaccccuuugauaauaggcuggagccucgguggccaugcuucuugccccuugggccuccccccagccccuccuccccuuccugcacccguacccccguggucuuugaauaaagucugagugggcggc

SEQ ID NO: 6621 - RNA, 436 nt, Artificial Sequence
  Description of Artificial Sequence: Synthetic Transcript sequence
gggaaauaagagagaaaagaagaguaagaagaaauauaagagccaccaugaccgaagaaaacgucaagagaagaacccauaauguccucgagcgccagcggcgcaaugagcucaagcgcagcuucuuugcacucagggaccaaauuccagaguuggagaacaacgaaaaggccccgaagguggugauccuuaagaaggcgacugccuacauccugucggugcaggcugagacucaaaagcugaucuccgaaaucgaucugcuccggaaacagaacgaacaacugaaacacaaacuggaacagcugcggaauucaugcugauaauaggcuggagccucgguggccaugcuucuugccccuugggccuccccccagccccuccuccccuuccugcacccguacccccguggucuuugaauaaagucugagugggcggc

SEQ ID NO: 6622 - protein, 7 aa, Homo sapiens
GPLGSIR

SEQ ID NO: 6623 - protein, 14 aa, Homo sapiens
ATAYILSVQAETQK

SEQ ID NO: 6624 - protein, 15 aa, Homo sapiens
KATAYILSVQAETQK

SEQ ID NO: 6625 - protein, 10 aa, Homo sapiens
LISEIDLLRK

SEQ ID NO: 6626 - protein, 17 aa, Homo sapiens
SCPCLAQEGPQGDLLTK

SEQ ID NO: 6627 - DNA, 824 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagtagtgctttctactttatgtggtctttgaataaagcctgagtaggaaggcggccgctcgagcatgcatctaga

SEQ ID NO: 6628 - RNA, 782 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguagugcuuucuacuuuauguggucuuugaauaaagccugaguaggaag

SEQ ID NO: 6629 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctactttattggtctttgaataaagcctgagtaggaaggcggccgctcgagcatgcatctaga

SEQ ID NO: 6630 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacuuuauuggucuuugaauaaagccugaguaggaag

SEQ ID NO: 6631 - DNA, 817 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagtagtgctttctgtggtctttgaataaagcctgagtaggaaggcggccgctcgagcatgcatctaga

SEQ ID NO: 6632 - RNA, 775 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguagugcuuucuguggucuuugaauaaagccugaguaggaag

SEQ ID NO: 6633 - DNA, 826 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctcttccataaagtaggaaacactacatggtctttgaataaagcctgagtaggaaggcggccgctcgagcatgcatctaga

SEQ ID NO: 6634 - RNA, 784 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuccauaaaguaggaaacacuacauggucuuugaauaaagccugaguaggaag

SEQ ID NO: 6635 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctacactactggtctttgaataaagcctgagtaggaaggcggccgctcgagcatgcatctaga

SEQ ID NO: 6636 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacacuacuggucuuugaauaaagccugaguaggaag

SEQ ID NO: 6637 - DNA, 819 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctcttccataaagtaggaaatggtctttgaataaagcctgagtaggaaggcggccgctcgagcatgcatctaga

SEQ ID NO: 6638 - RNA, 777 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuccauaaaguaggaaauggucuuugaauaaagccugaguaggaag

SEQ ID NO: 6639 - DNA, 825 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctaacccatggaattcagttctcatggtctttgaataaagcctgagtaggaaggcggccgctcgagcatgcatctaga

SEQ ID NO: 6640 - RNA, 783 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaacccauggaauucaguucucauggucuuugaauaaagccugaguaggaag

SEQ ID NO: 6641 - DNA, 810 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctagttctctggtctttgaataaagcctgagtaggaaggcggccgctcgagcatgcatctaga

SEQ ID NO: 6642 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaguucucuggucuuugaauaaagccugaguaggaag

SEQ ID NO: 6643 - DNA, 818 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggctgccttctgcggggcttgccttctggccatgcccttcttctctcccttgcacctgtacctctaacccatggaattcatggtctttgaataaagcctgagtaggaaggcggccgctcgagcatgcatctaga

SEQ ID NO: 6644 - RNA, 776 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuaacccauggaauucauggucuuugaauaaagccugaguaggaag

SEQ ID NO: 6645 - protein, 11 aa, Homo sapiens
MSCSGCNGMWA

SEQ ID NO: 6646 - protein, 11 aa, Homo sapiens
RNSGAGMGRMR

SEQ ID NO: 6647 - protein, 13 aa, Homo sapiens
RNSGAGMGRMRRR

SEQ ID NO: 6648 - protein, 12 aa, Homo sapiens
RMSCSGCNGMWR

SEQ ID NO: 6649 - DNA, 10 bp, Homo sapiens
gacgagagga

SEQ ID NO: 6650 - DNA, 10 bp, Homo sapiens
gacgagagaa

SEQ ID NO: 6651 - DNA, 10 bp, Homo sapiens
cgccgctgaa

SEQ ID NO: 6652 - DNA, 10 bp, Homo sapiens
cgccgcggaa

SEQ ID NO: 6653 - DNA, 10 bp, Homo sapiens
cgccgccgaa

SEQ ID NO: 6654 - DNA, 10 bp, Homo Sapiens
agccgccgca

SEQ ID NO: 6655 - DNA, 10 bp, Homo Sapiens
acgccgccga

SEQ ID NO: 6656 - DNA, 12 bp, Homo Sapiens
ggcattcatcgt

SEQ ID NO: 6657 - DNA, 12 bp, Homo Sapiens
gcattagtatct

SEQ ID NO: 6658 - DNA, 12 bp, Homo Sapiens
tcggttattgtt

SEQ ID NO: 6659 - DNA, 12 bp, Homo Sapiens
tccaattgggaa

SEQ ID NO: 6660 - DNA, 12 bp, Homo Sapiens
atctattggcca

SEQ ID NO: 6661 - DNA, 12 bp, Homo Sapiens
ttactgggtgtt

SEQ ID NO: 6662 - DNA, 12 bp, Homo Sapiens
agggtgaaggtc

SEQ ID NO: 6663 - DNA, 12 bp, Homo Sapiens
ggtgggtgtgtc

SEQ ID NO: 6664 - DNA, 12 bp, Homo Sapiens
cgcttcaatgct

SEQ ID NO: 6665 - DNA, 12 bp, Homo Sapiens
tgcttcaatgcc

SEQ ID NO: 6666 - DNA, 12 bp, Homo Sapiens
tgtgtctttgca

SEQ ID NO: 6667 - DNA, 12 bp, Homo Sapiens
cacggggacagc

SEQ ID NO: 6668 - DNA, 12 bp, Homo Sapiens
aagctgtacatg

SEQ ID NO: 6669 - DNA, 12 bp, Homo Sapiens
gatgggggcaca

SEQ ID NO: 6670 - DNA, 12 bp, Homo Sapiens
atatgtgccctt

SEQ ID NO: 6671 - DNA, 12 bp, Homo Sapiens
tccttctgggtc

SEQ ID NO: 6672 - DNA, 12 bp, Homo Sapiens
ggtgggtgtgtc

SEQ ID NO: 6673 - DNA, 12 bp, Homo Sapiens
gaatggatgggg

SEQ ID NO: 6674 - DNA, 12 bp, Homo Sapiens
  misc_feature (3)..(3): n is a, c, g, or t
cangtgatattc

SEQ ID NO: 6675 - DNA, 12 bp, Homo Sapiens
aggagggtttgt

SEQ ID NO: 6676 - DNA, 12 bp, Homo Sapiens
tgggcgagtggg

SEQ ID NO: 6677 - DNA, 12 bp, Homo Sapiens
cggctcaccagt

SEQ ID NO: 6678 - DNA, 12 bp, Homo Sapiens
  misc_feature (7)..(7): n is a, c, g, or t
ggtttcnataac

SEQ ID NO: 6679 - DNA, 12 bp, Homo Sapiens
ggtgggtgtgtc

SEQ ID NO: 6680 - DNA, 12 bp, Homo Sapiens
ttactgggtgtt

SEQ ID NO: 6681 - DNA, 12 bp, Homo Sapiens
aagtctttgggt

SEQ ID NO: 6682 - DNA, 90 bp, Homo sapiens
gggagacggcggcggtggcggcgcgggcagagcaaggacgcggcggatcccactcgcacagcagcgcactcggtgccccgcgcagggtcg

SEQ ID NO: 6683 - DNA, 75 bp, Homo sapiens
aaagaaatggaatcgaagagaatggaaacaaatggaatggaattgaatggaatggaattgaatggaatgggaacg

SEQ ID NO: 6684 - DNA, 75 bp, Homo sapiens; identical to SEQ ID NO: 6683

SEQ ID NO: 6685 - DNA, 87 bp, Homo sapiens
agacagtcagacaatcacaaagaaacaagaatgaaaatgaatgaacaaaaccttcaagaaatatgggattatgaagaggccaaatgt

SEQ ID NO: 6686 - DNA, 78 bp, Homo sapiens
aaaaggaaatacaagacaacaaacacagaaacacaaccatcgggcatcatgaaacctcgtgaagataatcatcagggt

SEQ ID NO: 6687 - DNA, 88 bp, Homo sapiens
agaccctaatatcacagttaaacgaactagagaaggaagagcaaacaaattcaaaagctagcggaaagcaagaaataactaagaccag

SEQ ID NO: 6688 - DNA, 90 bp, Homo sapiens
aaagacttaaacataagacctaaaaccataaaaaccacagaagaaaacataggcaatgccattcaggacataggcatgggcaaagacttc

SEQ ID NO: 6689 - DNA, 92 bp, Homo sapiens
agcaataaccaaacaacctcattaaaaagtaggcaaaggacataaacagacacttttcaaaagaagacatacacgtggccaacaaacatatg

SEQ ID NO: 6690 - DNA, 90 bp, Homo sapiens
agaaagaatcaagaggaaatgcaagaaatccaaaacactgtaacagatatgatgaataatgaggtatgcactcatcagcagactcgacat

SEQ ID NO: 6691 - DNA, 75 bp, Homo sapiens
gcactagtcagatcaagacagaaagtcaacgaacaaagaacagacttaaactacactctagaacaaatggaccta

SEQ ID NO: 6692 - DNA, 72 bp, Homo sapiens
agcagccaacaagcatatgaaataatgctccacaacactcatcatcagagaaatgcaaatcaaaaccaaaat

SEQ ID NO: 6693 - DNA, 90 bp, Homo sapiens
aatatacgcaaatcaataaatgtaatccagcatataaacagtactaaagacaaaaaccacatgattatctcaatagatgcagaaaaggcc

SEQ ID NO: 6694 - DNA, 92 bp, Homo sapiens
atgtacacaaatcaataaatgcagtccagcatataaacagaaccaaacacaaaaaccacatgattatctcaatagatgcagaaaaggccttt

SEQ ID NO: 6695 - DNA, 84 bp, Homo sapiens
tataccacacaaatgcaaaagattattagcaacaattatcaacagcaatatgtcaacaagttgacaaacctagaggacatggat

SEQ ID NO: 6696 - DNA, 85 bp, Homo sapiens
aaacacacaaagcaacaaaagaacgaagcaacaaaagcatagatttattgaaatgaaagtacattctacagagtgggggcaggct

SEQ ID NO: 6697 - DNA, 72 bp, Homo sapiens
gaaatcatcatcaaacggaatcgaatggaatcattgaatggaatggaatggaatcatcatggaatggaaacg

SEQ ID NO: 6698 - DNA, 90 bp, Homo sapiens
aacagaatggaatcaaatcgaatgaaatggaatggaatagaaaggaatggaatgaaatggaatggaaaggattcgaatggaatgcaatcg

SEQ ID NO: 6699 - DNA, 102 bp, Homo sapiens
tacaaagaactcaaacaaatcagcaagaacaaaaacaatcccaacaaaatgttggacaaagacatgaatagacaattctcgaaagaagatgtacaaatggct

SEQ ID NO: 6700 - DNA, 79 bp, Homo sapiens
tgttgagagaaattaaacaaagcacagataaatggaaaaacgtgttcatagattgaaagacttcatgttgtatggtgtc

SEQ ID NO: 6701 - DNA, 124 bp, Homo sapiens
aaacgattggacaggaatggaatcaccatcgaatggaaacgaatggaatcttcgaatggaattgaatgaaattattgaacggaatcaaatagaatcatcattgaacagaatcaaattggatcat

SEQ ID NO: 6702 - DNA, 85 bp, Homo sapiens
aacaataaacaaactccaactagacacaatagtcaaattgctgaaaatgaaatataaaggaacaatctcgatggtagcccaagga

SEQ ID NO: 6703 - DNA, 84 bp, Homo sapiens
aaatcaataaatgtaattcagcatataaacagaaccaaagacaaaaaccacatgattatctcaatagatgcagaaaaggccttt

SEQ ID NO: 6704 - DNA, 84 bp, Homo sapiens
gctcaaggaaataaaataggacacaaagaaatggaaaaacattccatactcatggatagaaagaatcaatatcatgaaatggcc

SEQ ID NO: 6705 - DNA, 90 bp, Homo sapiens
aacatacgcaaatcaataaatgtaatccagcatataaacagaaccaaagacaaaaaccacatgattatctcaatagatgcagaaaaggcc

SEQ ID NO: 6706 - DNA, 84 bp, Homo sapiens
aacaatcactagtccttaagtaagagacaacaccttttgtcacacacagtttgtcctaactttatcttggtaattggggagacc

SEQ ID NO: 6707 - DNA, 54 bp, Homo sapiens
agaaaacacacagacaacaaaaaacacagaacgacaatgacaaaatggccaagc

SEQ ID NO: 6708 - DNA, 87 bp, Homo sapiens
acacaacaaccaagaaacaaccccattaagaagtgggaaaaatacatgaataaacacatctcaaaagaagacaaacaagtggctaac

SEQ ID NO: 6709 - DNA, 88 bp, Homo sapiens
acagcagaaaacgaacatcagaaaatcactctacatgatgcttaaatacagagggcaagcaacccaagagaaaacaccacttcctaat

SEQ ID NO: 6710 - DNA, 90 bp, Homo sapiens
gaatagaacagaatggaatcaaatcgaatgaaatggaatggaatagaaaggaatggaatgaaatggaatggaaaggattcgaatggaatg

SEQ ID NO: 6711 - DNA, 68 bp, Homo sapiens
taagcagagaaaatatcaacacgaaaataatgcaaggagaaaaatacagaacaatccaaaatgtggcc

SEQ ID NO: 6712 - DNA, 84 bp, Homo sapiens
gaacaatcaatggaagcagaaacaaataaaccaaggtgtgcatcaaggaatacattcacgcatgatggctgtatgagtaaaatg

SEQ ID NO: 6713 - DNA, 81 bp, Homo sapiens
gatcaataaatgtaattcatcatataaacagagaactaaagacaaaaacacatgattatcgcaatacatgcagaaaaggcc

SEQ ID NO: 6714 - DNA, 91 bp, Homo sapiens
gacaagagttcagaaaggaagactacacagaaatacgcattttaaagtcactgacatggagatgacacttaaaaccatgaacatggatggg

SEQ ID NO: 6715 - DNA, 91 bp, Homo sapiens
aagcaaagaaagaatgaagcagcaaaagaacgaaagcaggaatttattgaaaaccaaagtacactccacagtatgggagcggacccgagca

SEQ ID NO: 6716 - DNA, 75 bp, Homo sapiens
accaacataagacaaagaaacatccagcagctgcctatggcaaaagattacaatgtgtcaaacaagagggcaatg

SEQ ID NO: 6717 - DNA, 88 bp, Homo sapiens
ggacaaattgctagaaataaacaaattaccaaaaatgattcaagtagagacagagaatcaaaatagaactacacataagtgggccaag

SEQ ID NO: 6718 - DNA, 75 bp, Homo sapiens
aacataatccatcaaataaacagaaccaaagacaaaaaccacatgattatctcaatagatgcagaaaaggccttc

SEQ ID NO: 6719 - DNA, 96 bp, Homo sapiens
aaaatcaatatgaaaacaaacacaagcagacaaagaaaattgggcaaaaggtttgagcagacacttcaccaaagaagtacaaatggcaaatcagca

SEQ ID NO: 6720 - DNA, 88 bp, Homo sapiens
aaccaaattagacaaattggaaatcattacacataacaaaagtaataaactgtcagcctcagtagtattcattgtacataaactggcc

SEQ ID NO: 6721 - DNA, 105 bp, Homo sapiens
aaggaatttaagcaaatcaacaagcaaaaccaaaataatcccattaaaaagtgggtaaaggacatgaatacacacttgtcaatagaggacattcaagtggccaac

SEQ ID NO: 6722 - DNA, 96 bp, Homo sapiens
taacctgatttgccataatccacgatacgcttacaacagtgatatacaagttacatgagaaacacaaacattttgcaaggaaactgtggccagatg

SEQ ID NO: 6723 - DNA, 95 bp, Homo sapiens
aactaacacaagaacagaaaaccaaacatcacatgttctcactcataagcgggagctgaacaatgagaacacacggacacagggagaggaacatg

SEQ ID NO: 6724 - DNA, 89 bp, Homo sapiens
taaactgacacaaacacagacacacagatacacacatacatacagaaatacacattcacacacagacctggtctttggagccagagatg

SEQ ID NO: 6725 - DNA, 83 bp, Homo sapiens
atcaacagacaacagaaacaaatccacaaagcacttagttattagaactgtcatacagactgtacaacaaccacatttaccat

SEQ ID NO: 6726 - DNA, 97 bp, Homo sapiens
aaataagccaacggtcataaattgcaaagccttttacaatccaaacatgatggaaacgatatgccattttgaaggtgatttgaaaagcacatggttt

SEQ ID NO: 6727 - DNA, 99 bp, Homo sapiens
aaacagttcaaaaattattgcaacaaaatgagagagatgagtttatcttgcaaactaatggatggtagcagtgacagtggcaaaacgtggtttgattct

SEQ ID NO: 6728 - DNA, 99 bp, Homo sapiens
taagcaacttcagcaaagtctcaggatacaaaatcaatgtacaaaaatcacaagcattcttatacaccaacaacagacaaacaagagtgccaaatcatg

SEQ ID NO: 6729 - DNA, 133 bp, Homo sapiens
agcaaacaaacaaacaaacaaacaaactatgacaggaacaaaacgtcacatatcaacattaacaaagaatgtaaacagcctaaatgcttcacttaaaagttatagacaggggctgggcatggtggctcacgcc

SEQ ID NO: 6730 - DNA, 84 bp, Homo sapiens
ggaaataacagagaacacaaacaaatgggaaaacattccatgttcatggataggaagaatcaatattgtgaaaatggccatact

SEQ ID NO: 6731 - DNA, 88 bp, Homo sapiens
agcaacttcagcaaagtctcaggatacaaaatcaatgtacaaaaatcacaagcattcttatacaccaataacagacaaacagagagcc

SEQ ID NO: 6732 - DNA, 84 bp, Homo sapiens
agataagaataaggcaaacatagtaatagggagttcatgaataacacacggaaagagaacttacagggctgtgatcaggaaacg

SEQ ID NO: 6733 - DNA, 85 bp, Homo sapiens
aggaaataaaagaagacacaaacaaatggaagaacattccatgcttatggatagggagaatcagtatcgtgaaaatggccatact

SEQ ID NO: 6734 - DNA, 93 bp, Homo sapiens
aacatacgaaaatcaataaacgtaatccagcatataaacagaaccaaagacaaaaaccacatgattatctcaatagatgcagaaaaggccttt

SEQ ID NO: 6735 - DNA, 85 bp, Homo sapiens
aatggactcgaatgaaatcatcatcaaacggaatcgaatggaatcattgaatggaatggaatggaatcatcatggaatggaaacg

SEQ ID NO: 6736 - DNA, 92 bp, Homo sapiens
aagatttaaacataagacctaaaacgacaaaaatcctaggagaaaacctaagcaataccattcaggacataggcatgggcaaagacttcatg

SEQ ID NO: 6737 - DNA, 87 bp, Homo sapiens
taatgagaagacacagacaacacaaagaatcacagaaacatgacacaggtgacaagaacaggcaaggacctgcagtgcacaggagcc

SEQ ID NO: 6738 - DNA, 80 bp, Homo sapiens
taaacgttagacctaaaaccataaaaaccctagaagaaaacctaggcattaccattcaggacataggcatgggcaaggac

SEQ ID NO: 6739 - DNA, 75 bp, Homo sapiens
gaattgaattgaatggaatggaatgcaatggaatctaatgaaacggaaaggaaaggaatggaatggaatggaatg

SEQ ID NO: 6740 - DNA, 69 bp, Homo sapiens
gtaatggaatggaatggaaaggaatcgaaacgaaaggaatggagacagatggaatggaatggaacagag

SEQ ID NO: 6741 - DNA, 99 bp, Homo sapiens
agagaaatgcaaatcaaaaccacaatggaataccatctcacgccagtcagaatggcaattattaaaaaatcacaacaattaatgatggcaaggctgtgg

SEQ ID NO: 6742 - DNA, 90 bp, Homo sapiens
aacatacacaaatcaataaacgtaatccagcttataaacagaaccaaagacaaaaaccacatgattatctcaatagatgcggaaaaggcc

SEQ ID NO: 6743 - DNA, 56 bp, Homo sapiens
taaacagaaccaaagacaaaaatcacatgattatctcaatagatgcagaaaaggcc

SEQ ID NO: 6744 - DNA, 76 bp, Homo sapiens
aatggaatgcaatcgaatggaatggaatcgaacggaatggaataaaatggaagaaaactggcaagaaatggaatcg

SEQ ID NO: 6745 - DNA, 77 bp, Homo sapiens
agataaaaagaacagcagccaaaatgacaaaagcaaaaagcaaaatcgtgttagagccaggtgtggtgatgtgtgct

SEQ ID NO: 6746 - DNA, 81 bp, Homo sapiens
aggaaagttttcaatatgagaaagatacaaaccaacagaataagcaaactggataaacagaaaatacagagagagccaagg

SEQ ID NO: 6747 - DNA, 82 bp, Homo sapiens
gcaatctcaggatacaaaatcaatgtgcaaaaatcacaagcattctcatacaccaataacagacaaacagagccaaatcatg

SEQ ID NO: 6748 - DNA, 103 bp, Homo sapiens
agcattcatatcttgcagtgttgggaaagagtgagaggttgtgatgtcaagaaggataggtcagaagtggaaggtatgggggattgtgcctgctgtcatggct

SEQ ID NO: 6749 - DNA, 88 bp, Homo sapiens
agcaacttcagcaaagtctcaggatacaaaatcaatgtgcaaaaatcacaagcattcttatacaccaataacagacaaacagagagcc

SEQ ID NO: 6750 - DNA, 88 bp, Homo sapiens
agcaacttcagcaaagtctcaggatacaaaatcaatgtgcaaaaatcacaagcattcttatacaccaacaacagacaaacagagagcc

SEQ ID NO: 6751 - DNA, 107 bp, Homo sapiens
taagccgataagcaacttcagcaaagtctcaggagacaaaatcaatgtgcaaaaaatcacaagcattcttatacactaataacagacaaacagagagccaaatcatg

SEQ ID NO: 6752 - DNA, 74 bp, Homo sapiens
aacgtgacatacatacaaaaagtttttagagcaagtgaaattttagctgctatatgttaattggtggtaatccc

SEQ ID NO: 6753 - DNA, 86 bp, Homo sapiens
tacgcaaatcgataaatgtaatccagcatataaacagaaccaaagacaaaaaccacatgattatctcaatagatgcagaaaaggcc

SEQ ID NO: 6754 - DNA, 68 bp, Homo sapiens
gcaatcgaatggaatggaatcgaacggaatggaataaaatggaagaaaactggcaagaaatggaatcg

SEQ ID NO: 6755 - DNA, 72 bp, Homo sapiens
ttgaatcgaatggaatcgaatggattggaaaggaatagaatggaatggaatggaattgactcaaatggaatg

SEQ ID NO: 6756 - DNA, 90 bp, Homo sapiens
taaagaaaaacaaacaaacagaaatcaatgaaaatcccattcaaaggtcagcaacctcaaagactgaaggtagataagcccacaaggatg

SEQ ID NO: 6757 - DNA, 77 bp, Homo sapiens
gtcatatttgggatttatcatctgtttctattgttgttgttttagtacacacaaagccacaataaatattctaggct

SEQ ID NO: 6758 - DNA, 77 bp, Homo sapiens
aaaagtacagaagacaacaaaaaatgagagagagaaagataacagactatagcagcattggtgatcagagccaccag

SEQ ID NO: 6759 - DNA, 87 bp, Homo sapiens
aacccacaaagacaacagaagaaaagacaacagtagacaaggatgtcaaccacattttggaagagacaagtaatcaaacacatggca

SEQ ID NO: 6760 - DNA, 105 bp, Homo sapiens
aaagaccgaaacaacaacagaaacagaaacaaacaacaataagaaaaaatgttaagcaaaacaaatgattgcacaacttacatgattactgagtgttctaatggt

SEQ ID NO: 6761 - DNA, 80 bp, Homo sapiens
aatcagtaaacgtaatacagcatataaacagaaccaaagacaaaaaccacatgattatctcaatagatgcagaaaaggcc

SEQ ID NO: 6762 - DNA, 97 bp, Homo sapiens
aagcaacttcagcaaagtctcaggacacaaaatcaatatgcgaaaatcacaagcattcctatacaccaataatagacaaacagagagccaaatcatg

SEQ ID NO: 6763 - DNA, 88 bp, Homo sapiens
agcaacttcagcaaaatctcaggatacaaaatcaatgtacaaaaatcacaagcattcttatacaccaacaacagacaaacagagagcc

SEQ ID NO: 6764 - DNA, 104 bp, Homo sapiens
taatgcaaactaaaacgacaatgagatatcaatacataactaccagaaaggctaacaaaaaaacagtcataacacaccaaaggctgatgagtgaggatgtgcag

SEQ ID NO: 6765 - DNA, 88 bp, Homo sapiens
agcaacttcagcaaagtctcaggatacaaaatcgatgtgcaaaaatcacaagcattcttatacaccaataacaggcaaacagagagcc

SEQ ID NO: 6766 - DNA, 93 bp, Homo sapiens
gatatataaacaagaaaacaactaatcacaactcaatatcaaagtgcaatgatggtgcaaaatgcaagtatggtggggacagagaaaggatgc

SEQ ID NO: 6767 - DNA, 74 bp, Homo sapiens
aagacagaacactgaaactcaacagagaagtaacaagaacacctaagacaaggaaggagagggaaggcaggcag

SEQ ID NO: 6768 - DNA, 75 bp, Homo sapiens
taagacacatagaaaacataaagcaaaatggcagatgtaaatgcaacctatcaatcaaaacattacgaatggctt

SEQ ID NO: 6769 - DNA, 95 bp, Homo sapiens
tgaaacaaatgataatgaaaatacaacataccaaacatacgagatacagtaaaagcagtactaagatgcaagtatatattgctacaagtgcctac

SEQ ID NO: 6770 - DNA, 135 bp, Homo sapiens
aatgtaatccagcatataaacagagccaaagacaaaaaccacatgattatctcaatagatgcagaaaaagcctttgacaaaattcaacaacccttcatgctaaaaactctcaataaattaggtattgatgggacg

SEQ ID NO: 6771 - DNA, 87 bp, Homo sapiens
acaaaattgatagaccactagcaagactaataaagaagaaaagagagaagaatcattaccattcaggacataggcatgggcaaggac

SEQ ID NO: 6772 - DNA, 85 bp, Homo sapiens
aaggattcgaatggaatgcaatcgaatggaatggaatcgaacggaatggaataaaatggaagaaaactggcaagaaatggaatcg

SEQ ID NO: 6773 - DNA, 75 bp, Homo sapiens
gatcatcagagaaacagagaaatgcaaattaaaaccacaatgagatactatctccacacaagtcagaatggctat

SEQ ID NO: 6774 - DNA, 95 bp, Homo sapiens
atcaaaagaaaagcaacctaacaaatacgggaagaatatttgaatagacatttcacaggaaaagatatatgaatggccaaaaagcaaatgaaaag

SEQ ID NO: 6775 - DNA, 58 bp, Homo sapiens
aacagcaatgacaatgatcagtaacaacaagacttttaactttgaaaaaatcaggacc

SEQ ID NO: 6776 - DNA, 91 bp, Homo sapiens
aagagcctgaatagctaaagtgatcataagcaaaaagaacaaagtcggaagcatcacattacctgacttcaaactatactcaaaggctatg

SEQ ID NO: 6777 - DNA, 101 bp, Homo sapiens
actcaggaaaaataacgaatccaactcacaggagaaagaagtacaaaccagaaaccaatttcaaattacaaggaccagaatactcatgttggctggccagt

SEQ ID NO: 6778 - DNA, 78 bp, Homo sapiens
ttgaccagaacacattacacaatgctaatcaactgcaaaggagaatatgaacagagaggaggacatggatattttgtg

SEQ ID NO: 6779 - DNA, 92 bp, Homo sapiens
aacatatggaaaaaaactcaacatcactgatcattagagaaatgcaaatcaaaaccacaatgagataccatctcacgccagtcagaatggcg

SEQ ID NO: 6780 - DNA, 88 bp, Homo sapiens
agcaacttcagcaaagactcaggatacaaaatcaatgtgcaaaaatcacaagcattcttatacaccaataacagacagagagccaaat

SEQ ID NO: 6781 - DNA, 84 bp, Homo sapiens
tgggatatgggtgaaagaacaagtttgcagaaaagatacagtgaattatggaccatgagttcgggaaagaagggtaggactgcg

SEQ ID NO: 6782 - DNA, 79 bp, Homo sapiens
agcagtgcaagaacaacataacatacaagtaaacaaacacatggggccaggtaataaaaagtcaggctcaagaggtcag

SEQ ID NO: 6783 - DNA, 91 bp, Homo sapiens
aaggaaaagtaaaaggaacttaacaccttcaagaaaagacagacaaataacaaaacagcagtttgatagaatgagatatcaggggatggca

SEQ ID NO: 6784 - DNA, 96 bp, Homo sapiens
gctagttcaacatatgcaaatcaataaacgtaatccatcacataaacagaaccaatgacaaaaaccacgattatctcaatagatgcagaaaaggcc

SEQ ID NO: 6785 - DNA, 76 bp, Homo sapiens
aacatcactgatcattagaaacacacaaatcaaaaccacaataagataccatctaacaccagtcacaatggctatt

SEQ ID NO: 6786 - DNA, 80 bp, Homo sapiens
agagcatccacaaggcccaattcaaagaatctgaaataatgtattgttactgcaacagttgtgagtaccagtggcatcag

SEQ ID NO: 6787 - DNA, 70 bp, Homo sapiens
ggaataacaacaacaacaaccaaaagacatatagaaaacaaacagcacgatggcagatgtaaagcctacc

SEQ ID NO: 6788 - DNA, 103 bp, Homo sapiens
aaacgcagaaacaaatcaacgaaagaacgaagcaatgaaagacaaagcaacaaaagaatggagtaagaaagcacactccacaaagtggaagcaggctgggaca

SEQ ID NO: 6789 - DNA, 88 bp, Homo sapiens
agcaacttcagcaaagtctcaggatacaaaatcaatgtgcaaaaatcacaagcattcctatacaccaacaacagacaaacagagagcc

SEQ ID NO: 6790 - DNA, 88 bp, Homo sapiens
agcaacttcagcaaagtctcaggatacaaaatcaatgggaaaaaatcacaagcattcctatacatcaataacagacaaacagagagcc

SEQ ID NO: 6791 - DNA, 88 bp, Homo sapiens
acacatttcaaggaaggaaacaagaacagacagaaacacaacatacttcatgaaaccacattttagcatcctggccgagtattcatca

SEQ ID NO: 6792 - DNA, 88 bp, Homo sapiens
agcaacttcagcaaagtctcaggacacaaaatcaatgtgcaaaaatcacaagcattcttatacaccaataacagacaaacagagagcc

SEQ ID NO: 6793 - DNA, 109 bp, Homo sapiens
tattttaccagattattcaagcaatatatagacagcttaaagcatacaagaagacatgtatagatttacatgcaaacactgcaccactttacataagggacttgagcac

SEQ ID NO: 6794 - DNA, 89 bp, Homo sapiens
cccaacttcaaattatactacaaggctacagtaatcaaaaaagcatagtactattacaaaaacagacacacaggccaatggaatacaat

SEQ ID NO: 6795 - DNA, 96 bp, Homo sapiens
agaaaggattcgaatggaatgaaaaagaattgaatggaatagaacagaatggaatcaaatcgaatgaaatggaatggaatagaaaggaatggaatg

SEQ ID NO: 6796 - DNA, 86 bp, Homo sapiens
gtttacagtcaagtgtacaaacagaatataagcaaacaaaagagaacatatacttacaaactatgctaagtgccatgaaggaaaag

SEQ ID NO: 6797 - DNA, 92 bp, Homo sapiens
aagagtattgaagttgacatatctagactgatcaagaacaaagacaaaaggtacagattatcaagaaaatgagcgggcaaagcaagatggcc

SEQ ID NO: 6798 - DNA, 102 bp, Homo sapiens
agtagaattgcaattgcaaatttcacacatatactcacacacaagtacacacatccacttttacaactaaaaaaactagcacccaggacaggtgcagtggct

SEQ ID NO: 6799 - DNA, 147 bp, Homo sapiens
tgaatgctatagagcagtaaaaacaaataaatgaactacattacagctacttacaaccatatgaaagaatataaccataacaatgatgagtggacaaaagctaagtgtgaaagaatgcatagtgctacagcagccaacatttacagc

SEQ ID NO: 6800 - DNA, 74 bp, Homo sapiens
gaatggaatcaaatagaatggaatcgaaacaaatggaatggaatggaatgggagctgagattgtgtcactgcac

SEQ ID NO: 6801 - DNA, 86 bp, Homo sapiens
taaaagtgtgctcaacatcattgatcatcagagaaatgcaaatcaaaactacaatgagatatcatctcatcccagtcaaagtggct

SEQ ID NO: 6802 - DNA, 61 bp, Homo sapiens
tcagaccatagcagataacatgcacattagcaatacgattgccatgacagagtggttggtg

SEQ ID NO: 6803 - DNA, 62 bp, Homo sapiens
acaaacaatccaattcgaaaatgggcaagatatttcaccaaagacatgagctgatatttcac

SEQ ID NO: 6804 - DNA, 98 bp, Homo sapiens
aggaaaaacaacaacaacaacaggaaaacaacctcagtatgaagacaagtacattgatttattcaacatttactgatcacttttcaggtggtaggcag

SEQ ID NO: 6805 - DNA, 106 bp, Homo sapiens
aacaaaacaaaaacccaactcaataacaagaagacaaacaacccaatttaaaatgagcaaagaacttgataaacatgtctccaaagaagatacggccaaagagcac

SEQ ID NO: 6806 - DNA, 90 bp, Homo sapiens
atacaactaaagcaaatataagcaactaaagcaacagtacaactaaagcaaaacagaacaagactgccagggcctagaaaagccaagaac

SEQ ID NO: 6807 - DNA, 95 bp, Homo sapiens
aacaacaacaacaacaggaaaacaacctcagtatgaagacaagtacattgatttattcaacatttactgatcacttttcaggtggtaggcagacc

SEQ ID NO: 6808 - DNA, 86 bp, Homo sapiens
agagagtattcatcatgaggagtattactggacaaataattcacaaacgaacaaaccaaagcgatcatctttgtactggctggcta

SEQ ID NO: 6809 - DNA, 69 bp, Homo sapiens
agtaaatcaccataaagaaggtaagagttcattcacaaaaacaacaaactgaagaatcaggccatagta

SEQ ID NO: 6810 - DNA, 86 bp, Homo sapiens
aaaatagaatgaaagagaatcaaatggaattgaatcgaatggaatcgaatggattggaaaggaatagaatggaatggaatggaatg

SEQ ID NO: 6811 - DNA, 79 bp, Homo sapiens
aaaagatgcaaaagtagcaaatgcaatgttaaaacaagcaaagaaagaatcaggtggaccacatagtgcagtgcttctc

SEQ ID NO: 6812 - DNA, 62 bp, Homo sapiens
ttcacagcagcattacgcacaatagccagaaggtgggaacagacaaaatgccttttgatggg

SEQ ID NO: 6813 - DNA, 74 bp, Homo sapiens
ccataacacaattaaaaacaacctaaatgtctaatagaagaacactgttcagaccgggcatggtggcttatacc

SEQ ID NO: 6814 - DNA, 88 bp, Homo sapiens
tggatttcagatatttaacacaaaatagtcaaagcagataaatactagcaacttatttttaatgggtaacatcatatgttcgtgcctt

SEQ ID NO: 6815 - DNA, 138 bp, Homo sapiens
atcattgaatgcaatcacatggaatcatcacagaatggaatcgtacggaatcatcatcgaatggaattgaatggaatcatcaattggactcgaatggaaacatcaaatggaatcgattggaagtgtcgaatggactcg

SEQ ID NO: 6816 - DNA, 99 bp, Homo sapiens
agaaacagccagaaaacaattattacctacagcattaaaactattcaaatgacagcatatttttcagcagaaatcatgaaggccagaaggacgtgtcat

SEQ ID NO: 6817 - DNA, 87 bp, Homo sapiens
aaaatgatcatgagaaaattcagcaacaaaaccatgaaattgcaaagatattacttttgggatggaacagagctggaaggcaaagag

SEQ ID NO: 6818 - DNA, 76 bp, Homo sapiens
aaccactgctcaaggaaataagagagaacacaaacaaatgaaaaaacattccatgctcatggataggaagaatcag

SEQ ID NO: 6819 - DNA, 77 bp, Homo sapiens
tactctcagaagggaagcagatattcagcataaatcatattgtttgtacaaagagtctgggcatggtgaatgacact

SEQ ID NO: 6820 - DNA, 109 bp, Homo sapiens
tatagttgaatgaacacacatacacacacacatgccacaaaacaaaaacaaagttatcctcacacacaggatagaaaccaaaccaaatcccaacacatggcaagatgat

SEQ ID NO: 6821 - DNA, 95 bp, Homo sapiens
gctcaaagaaatcagaaatgacacaagcaaatggaaaaacatgccatgttcatgaatatgaagaatcaatattgttaaaatggccatactgctca

SEQ ID NO: 6822 - DNA, 67 bp, Homo sapiens
ggatacaaaatcaatgtacaaaaatcacaagcattcttatacaccaataacagacaaacagagagcc

SEQ ID NO: 6823 - DNA, 88 bp, Homo sapiens
agcaacttcagcaaagtctcaggatacaaaatcaatgtacaaaaatcacaagcattcttatacaccaacaacagacaaacagagagcc

SEQ ID NO: 6824 - DNA, 83 bp, Homo sapiens
aggagaatagcagtagaatgacaaaattagattttcacatgaaacttgatgacagtgtaggaaatggactgaaaggacaagac

SEQ ID NO: 6825 - DNA, 88 bp, Homo sapiens
agcaacttcagcaaagtctcgggatacaaaatcaatgtgcaaaaatcacaagcattcctatacaccaataacaggcaaacagagagcc

SEQ ID NO: 6826 - DNA, 129 bp, Homo sapiens
aagttcaaacatcagtattaaccttgaacatcaatggcctacatgcatcacttaaaacatacagacaggcaaattgggttaagaaaacaaacaagcaaacaaaacatgttccaaacatttgttggctat

SEQ ID NO: 6827 - DNA, 95 bp, Homo sapiens
aagaaacaatcaaaaggaagtgctagaaataaaacacactgtaatagaaaagaagaatgccttatgggcttatcaatagactagacatggccagg

SEQ ID NO: 6828 - DNA, 139 bp, Homo sapiens
aaagaaagacagagaacaaacgtaattcaagatgactgattacatatccaagaacattagatggtcaaagactttaagaaggaatacattcaaaggcaaaaagtcacttactgattttggtggagtttgccacatggac

SEQ ID NO: 6829 - DNA, 88 bp, Homo sapiens
agcaacttcagcaaagtttcaggatacaaaatcaatgtgcaaaaatcacaagcattcttatacaccaacaacagacaaacagagagcc

SEQ ID NO: 6830 - DNA, 71 bp, Homo sapiens
agaatcaaatggaattgaatcgaatggaatcgaatggattggaaaggaatagaatggaatggaatggaatg

SEQ ID NO: 6831 - DNA, 106 bp, Homo sapiens
aaacagaaccacagatatctgtaaaggattacactatagtattcaacagagtatggaacagagtatagtattcaacagagtatgcaaagaaactaaggccagaaag

SEQ ID NO: 6832 - DNA, 83 bp, Homo sapiens
aaaaaatgttcaacatcactagtcagcagagaaatgcaaatcaaaatcacaatgagataacttctcacaccagacagcatggc

SEQ ID NO: 6833 - DNA, 87 bp, Homo sapiens
gaatccatgttcatagcacaacaaccaaacagaagaaatcactgtgaaataagaaacaaagcaaaacacagatgtcgacacatggca

SEQ ID NO: 6834 - DNA, 68 bp, Homo sapiens
aggatacaaaatcaaagtgcaaaaatcacaagcattcttatacaccaataacagacaaacagagagcc

SEQ ID NO: 6835 - DNA, 101 bp, Homo sapiens
aacagatttaaacaaaccaacaagcaaaaaacgaacaactccattcaaacatggacaaaagacacgaacagacacttttcaaagaagacatacatgtggcc

SEQ ID NO: 6836 - DNA, 87 bp, Homo sapiens
aaagacaatatacaaatggccaataagcacatgaaaagacgctcaacatccttagtcgttaaggcaatgcaaatcaaaaccacaatg

SEQ ID NO: 6837 - DNA, 82 bp, Homo sapiens
taaacaacgagaacacatgaacacaaagaggggaacaacagacaccaagaccttcttgagggtggaggatgggaggagggag

SEQ ID NO: 6838 - DNA, 92 bp, Homo sapiens
ggttcaacttacaatattttgacttgacaacagtgcaaaagcaatacacgattagtagaaacacacttccaatgcccataggaccattctgc

SEQ ID NO: 6839 - DNA, 88 bp, Homo sapiens
agcaacttcagcaaagtctcaggatacaaaatcaatgagcaaaaatcacaagcattcttacacaccaataacagacaaacagagagcc

SEQ ID NO: 6840 - DNA, 67 bp, Homo sapiens
aatccagcatataaacagaaccaaagacaaaaaccacatgattatctcaatagatgcagaaaaggcc

SEQ ID NO: 6841 - DNA, 95 bp, Homo sapiens
tgaaaatacaaatgaccatgcaagtaattccgcagggagagagcggatatgaacaaacagaagaaatcagatgggatagtgctggcgggaagtca

SEQ ID NO: 6842 - DNA, 67 bp, Homo sapiens
gcaaatgattataagtgctgttatagaaacattcaaagaccagaaaaggaccacaatggctgaccac

SEQ ID NO: 6843 - DNA, 90 bp, Homo sapiens
agtcaataacaagaagacaaacaacccaattacaaaatgggatatgaatttaatagatgttactccaaggaagatacacaaatggccaac

SEQ ID NO: 6844 - DNA, 83 bp, Homo sapiens
atggttaaaactcaacaatgaaaacacaaacagcgcaatttaaaaatgggcaaaatgacaggccagacccagtggctcatgcg

SEQ ID NO: 6845 - DNA, 102 bp, Homo sapiens
taactactcacagaactcaacaaaacactatacatgcatttaccagtttattataaagatacaagtcaggaacagccaaatggaagaaatgtaaatggcaag

SEQ ID NO: 6846 - DNA, 98 bp, Homo sapiens
aacagaccataaataaacacagaagacacacgagtgtaaagtcagtgccccgctgcgaattaaatcggggtgatgtgatggcgagtgagtgggtagtt

SEQ ID NO: 6847 - DNA, 69 bp, Homo sapiens
gaatagaatagaatggaatcatcgaatggaatcgaatggaatcatcatgatatggaattgagtggaatc

SEQ ID NO: 6848 - DNA, 81 bp, Homo sapiens
ggaatctataatacagctgtttatagccaagcactaaatcatatgatacagaaaacaaatgcagatggtttgaagggtggg

SEQ ID NO: 6849 - DNA, 90 bp, Homo sapiens
aagatagagttgaaacagtggacaattaaagagtaatttggaagaatggtgaaattacagccatgctttgaatcaggcgggttcactggc

SEQ ID NO: 6850 - DNA, 80 bp, Homo sapiens
tgaaaagaagaatgaccataagcaagcagatgaaaaacaaaacagaatttttacagacgtcttggactgatatcttgggc

SEQ ID NO: 6851 - DNA, 82 bp, Homo sapiens
aggaatctataatacagctgtttatagccaagcactaaatcatatgatacagaaaacaaatgcagatggtttgaagggtggg

SEQ ID NO: 6852 - DNA, 84 bp, Homo sapiens
aggaaaagaaagaaatagaaaatgcgaaatggtaagaaaaaacagcataataaacatttgtatggtgttgatggacaatgcatt

SEQ ID NO: 6853 - DNA, 122 bp, Homo sapiens
taacagtaccaaaaaacagtcataatcttcaagagcttaaatttagcatgaaaggaagacattcatcaaagaatcacacaaaggaatgtaaaattaaatggagattagtgccaggaaagagc

SEQ ID NO: 6854 - DNA, 82 bp, Homo sapiens
gcaaaacacaaacaacgccataaaaaactgggcaaaggatatgaacagacatttttcaaaacaaaacatacttatggccaac

SEQ ID NO: 6855 - DNA, 100 bp, Homo sapiens
aacaaaattgaacaacatgcaaagaaacataaacgaagcaatgaaagtgtgcagatccactgaaatgaaagtgctgtccagagtgggagccagctcgaga

SEQ ID NO: 6856 - DNA, 113 bp, Homo sapiens
gaatggaatcaacatcaaacggaatcaaacggaattatcgaatggaatcgaagagaatcatcgaatggccacgaatggaatcatctaatggaatggaatggaataatccatgg

SEQ ID NO: 6857 - DNA, 137 bp, Homo sapiens
tacaagaaaatcacagtaacatttataaaacacagaagtgtgaacacacagctattgaccttgaaaacagtgaaagagggtcagctgtagaactaagacataagcaaagtttttcaatcaagaatacatgggtggcc

SEQ ID NO: 6858 - DNA, 87 bp, Homo sapiens
aagaattggacaaaacacacaaacaaagcaaggaaggaatgaaaggatttgttgaaaatgaaagtacactccacagtgtgggagcag

SEQ ID NO: 6859 - DNA, 92 bp, Homo sapiens
acagttaacaaaaaccgaacaatctaattacgaaatgaacaaaagatatgaacagacatttcacccgagagtatacaggggccaggcatggt

SEQ ID NO: 6860 - DNA, 83 bp, Homo sapiens
aaacgcacaaacaaagcaaggaaagaatgaagcaacaaaagcagagatttattgaaaatgaaaaatacactccacagggtggg

SEQ ID NO: 6861 - DNA, 86 bp, Homo sapiens
caccatgagtcattaggtaaatgcaaatcaaaaccacaatgaaatacttcacacccatgaagatggctataataaaaaaacagaca

SEQ ID NO: 6862 - DNA, 88 bp, Homo sapiens
agcaacttcagcaaagtctcaggagacaaaatcaatgtacaaaaatcacaagcattcttatacaccaataacagacaaacagagagcc

SEQ ID NO: 6863 - DNA, 97 bp, Homo sapiens
tgacatgcaagaaataaggaagtgcaaaaacaaacaaacaaacaacaacaacaacaacaacaacaacaacaaaaaacagtcccaaaaggatgggcag

SEQ ID NO: 6864 - DNA, 80 bp, Homo sapiens
agacttgaaaagcacagacaacgaaagcaaaaatggacaaatggaatcacatcaagctaaaaggttttgcatggcaaagg

SEQ ID NO: 6865 - DNA, 83 bp, Homo sapiens
gcaaaagaaacaatcagtagagtaaacagacaactcatagaatgcaagaaaatcatcgcaatctgtacatccaacaaagggct

SEQ ID NO: 6866 - DNA, 86 bp, Homo sapiens
acaaaatcaaactaacctcgataagaatgcaagtgaatcaaaatgagtttcaaggggttgtggctagtacacgctttctacagctg

SEQ ID NO: 6867 - DNA, 96 bp, Homo sapiens
acaaaccactgctcaaggaaataaggacacaaacaaatggaacaacattccgtgctcatggataggaagaatcaatatcgtgaaaatggccatact

SEQ ID NO: 6868 - DNA, 86 bp, Homo sapiens
gaacgatttatcactgaaaattaatactcatgcaagtagtaaacgaatgtaatgaccatgataaggagacggacggtggtgatagt

SEQ ID NO: 6869 - DNA, 73 bp, Homo sapiens
agcagaagaaataactgaaatcagagtgaaactgaatcaaattgagatgcaaaaatacatacgaaatggccag

SEQ ID NO: 6870 - DNA, 91 bp, Homo sapiens
tgaatagacacacagaccaatggaacagaatagagaacacagaataaatctgcacacttatagccagctgatttttgacaaatttgccaag

SEQ ID NO: 6871 - DNA, 86 bp, Homo sapiens
agcaacttcagcagtctcagtatacaaaaacaatgtgcaaaaatcacaagcattcctatatgccaataacagacaaacagagagcc

SEQ ID NO: 6872 - DNA, 61 bp, Homo sapiens
accaatcaagaaaacaatgcaacccacagagaatggacaaaagcaaggcaggacaatggct

SEQ ID NO: 6873 - DNA, 89 bp, Homo sapiens
gccacaattttgaaacaaccataataatgagaatacacaagacaactccaataatgtgggaagacaaactttgcaattcacatcatggc

SEQ ID NO: 6874 - DNA, 82 bp, Homo sapiens
gaaaatgaacaatatgaacaaacaaacaaaattactacccttacgaaagtacgtgcattctagtatggtgacaaaaaggaaa

SEQ ID NO: 6875 - DNA, 85 bp, Homo sapiens
tatgcaaatcaataaacataatccatcacataaacagaaacaaagacaaaatgacatgattatctcaatagatgcagaaaaggcc

SEQ ID NO: 6876 - DNA, 133 bp, Homo sapiens
cacccatctgtaggaccaggaagcctgatgtgggagagaacagcaggctaaatccagggttggtctctacagcagagggaatcacaagcctgttagcaagtgaagaaccaacactggcaagagtgtgaaggcc

SEQ ID NO: 6877 - DNA, 80 bp, Homo sapiens
aggatacaaaatcaatgtacaaaaatcacaaacattcttatacaccaacaacagacaaacagagagccaaatcatgggtg

SEQ ID NO: 6878 - DNA, 96 bp, Homo sapiens
aggaaaatgcaaatcagaacgactataacacaccatctcaaactcgttaggatggctattatcaaaaagtcaagagataacaaatgtgggcaaggg

SEQ ID NO: 6879 - DNA, 91 bp, Homo sapiens
gtaacaaaacagactcatagaccaatagaacagaatagagaattcagaaataagactgcacttctatgaccatgtgatcttagacaaacct

SEQ ID NO: 6880 - DNA, 91 bp, Homo sapiens
aaaggaaaactacaaaacactgctgaaagaaatcattgacaacacaaacaaatggaaacacatcccaagatcatgggtgggtggaatcaat

SEQ ID NO: 6881 - DNA, 121 bp, Homo sapiens
acacacataccaacagaacatgacaaaagaacaaaaccagccgcatgcatactcgatggagacaaaggtaacactgcagaatggtgaaggaagaacagtcattttaatgacagtgttggct

SEQ ID NO: 6882 - DNA, 95 bp, Homo sapiens
aactaagacaacagattgatttacactactattttcacacagccaaaaatatcactatggcaatcgtcaaaaggtcaattcaaagatgggacagt

SEQ ID NO: 6883 - DNA, 113 bp, Homo sapiens
gatcagcttagaatacaatggaacagaacagattagaacaatgtgattttattaggggccacagcactgttgactcaagtacaagttctgactcatgtagaactaacactttt

SEQ ID NO: 6884 - DNA, 74 bp, Homo sapiens
gaatggaatcaaatcgaatgaaatggaatggaatagaaaggaatggaatgaaatggaatggaaaggattcgaat

SEQ ID NO: 6885 - DNA, 86 bp, Homo sapiens
aaatgaacaaaactagaggaatgacattacctgacttcaaattatactacagagctatagtaaccaaaacagcatggtacaggcat

SEQ ID NO: 6886 - DNA, 91 bp, Homo sapiens
ggacaacatacacaaatcagtcaagatacatcatttcaacagaatgaaagacaaaaaccatttgatcacttcaatcgatgatgaaaaagca

SEQ ID NO: 6887 - DNA, 85 bp, Homo sapiens
aacttcagcaaattctcaggatacaaaatcaatgtgcaaaaaccacaagcattcctatacaccaataatagacagtgagccaaat

SEQ ID NO: 6888 - DNA, 79 bp, Homo sapiens
tatgactttcacaaattacagaaaaagacacccatttgacaagggaactgaaggtggtgaagacatactggcaggctac

SEQ ID NO: 6889 - DNA, 70 bp, Homo sapiens
aacagcaatagacacaaagtcagcacttacagtacaaaaactaatggcaaaagcacatgaagtgggacat

SEQ ID NO: 6890 - DNA, 76 bp, Homo sapiens
tgtaacactgcaaaccataaaaaccgtagaagaaaacctagacaatactattcaggacataggcatgggcaaagac

SEQ ID NO: 6891 - DNA, 83 bp, Homo sapiens
gaagaagaaaaaacatggatatacaatgtcaacagaaatcaaggagaaacggaatttcaccaatcaatttagtgatctgggtt

SEQ ID NO: 6892 - DNA, 106 bp, Homo sapiens
aaaacacacaaacatacatgtggatgcacatataaacatgcacatacacacacacataaatgcacaaacacacttaacacaagcacacatgcaaacaaacacatgg

SEQ ID NO: 6893 - DNA, 83 bp, Homo sapiens
tagaaggaatttgatacatgctcagaaatacaggcaaaggaagtaggtgcctgccagtgaacacaggggaactatggctccta

SEQ ID NO: 6894 - DNA, 131 bp, Homo sapiens
tgactaaacagagttgaacaagaacaaaaagcaaatttgcagaaatgaaatacatactaattgaaagtccatggacaggctcaacagatgatatagatacagctaaagagataattagtgaaatggatcag

SEQ ID NO: 6895 - DNA, 101 bp, Homo sapiens
aagtaataagactgaattagtaatacaaagtgtctcaacaaagaaaattgcgggactgttcatgctcatggacaggaagaatcaatatcatgaaaatggcc

SEQ ID NO: 6896 - DNA, 106 bp, Homo sapiens
acagacagagatttaaaacaataaacaagcagtaagcaaacacagataacaaaatgacatgatccaacaaatactcagaaggagacttagaaatgaattgagggtc

SEQ ID NO: 6897 - DNA, 85 bp, Homo sapiens
agaaaaaaacaaacagcccattaaaaggtagacaaaggacatgaacacttttcaaaagaagacatacatgtggccaaacagcatg

SEQ ID NO: 6898 - DNA, 79 bp, Homo sapiens
aaaaatgaccagagcaatagaatgcattgaccagataaagaccttcacgtatgttgaactaaaatgtgtggtgcaggtg

SEQ ID NO: 6899 - DNA, 81 bp, Homo sapiens
aatcagtctagatcttaaaggaacaccagagggagtatttaaatgtgcccaataagcaagaattatggtgatgtggaagta

SEQ ID NO: 6900 - DNA, 71 bp, Homo sapiens
gaatggaatggaaaggaatcgaaacgaaaggaatggagacagatggaatggaatggaacagagagcaatgg

SEQ ID NO: 6901 - DNA, 107 bp, Homo sapiens
ggaatggaatgaacacgaatgtaatgcaacccaatagaatggaatcgaatggcatggaatataaagaaatggaatcgaagagaatggaaacaaatggaatggaattg

SEQ ID NO: 6902 - DNA, 98 bp, Homo sapiens
aggacatgaatagacaattctcaaaagaagatacacaagtggcaaacaaacacatgaaaaaagactcaacattagtaatgaccatggaaatgcaaatc

SEQ ID NO: 6903 - DNA, 92 bp, Homo sapiens
tccagtcgatcatcatatagtcagcacttatcatacaccaagccgtgtgcaaggaaagggaatacaaccatgaacatgatagatggatggtt

SEQ ID NO: 6904 - DNA, 91 bp, Homo sapiens
tacagataagaaaattgagactcaagagtattacataaattgtttcagctaccacagcaaaaaatggtatggttgggaatcaagctcaggg

SEQ ID NO: 6905 - DNA, 113 bp, Homo sapiens
agcctatcaaaaagtgggctaagaatatgaatacacaattctcaaaagaagatatacaaatgggcaacaaacatatgaaaacatactcaacatcactaatgatcagggaaatg

SEQ ID NO: 6906 - DNA, 83 bp, Homo sapiens
gaaaatgaacaatatgaacaaacaaacaaaattactacccttacgaaagtacgtgcattctagtatggtgacaaaaaggaaag

SEQ ID NO: 6907 - DNA, 95 bp, Homo sapiens
acatacgcaaatcaataaacataatccatcacataaacagaaccaaagacaaaaatcacatgattatctcaatagatgcagaaaaggccttcgac

SEQ ID NO: 6908 - DNA, 77 bp, Homo sapiens
aagagtatcaacagtaaattacattagcagaagaatcaacaaacatgaaaatagaaattatggtagccaaagaacag

SEQ ID NO: 6909 - DNA, 75 bp, Homo sapiens
aatcgaatggaatcaacatcaaacggaaaaaaacggaattatcgaatggaatcgaagagaatcatcgaatggacc

SEQ ID NO: 6910 - DNA, 110 bp, Homo sapiens
gaaaggaatagaatggaatggatcgttatggaaagacatcgaatgggatggaattgactcgaatggattggactggaatggaacggactcgaatggaatggactggaatg

SEQ ID NO: 6911 - DNA, 94 bp, Homo sapiens
taagcaatttcagcagtctcaggatacaaaatcaatgtgcaaaaatcacaagcattcttatacaccaacaacagacaaacagagagccaaatcg

SEQ ID NO: 6912 - DNA, 105 bp, Homo sapiens
aacggaatcaaacggaattatcgaatggaatcgaagagaatcatcgaatggccacgaatggaatcatctaatggaatggaatggaataatccatggacccgaatg

SEQ ID NO: 6913 - DNA, 93 bp, Homo sapiens
acatcaaacggaatcaaacggaattatcgaatggaatcgaaaagaatcatcgaacggactcgaatggaatcatctaatggaatggaatggaag

SEQ ID NO: 6914 - DNA, 74 bp, Homo sapiens
atcgaatggaatcaacatcaaacggaaaaaaacggaattatcaaatggaatcgaagagaatcatcgaatggacc

SEQ ID NO: 6915 - DNA, 86 bp, Homo sapiens
gaataatcattgaacggaatcgaatggaaacatcatcgaatggaaacgaatggaatcatcatcgaatggaaatgaaaggagtcatc

SEQ ID NO: 6916 - DNA, 110 bp, Homo sapiens
catcaaacggaatcaaacggaattatcgaatggaatcgaaaagaatcatcgaacggactcgaatggaatcatctaatggaatggaatggaagaatccatggactcgaatg

SEQ ID NO: 6917 - DNA, 97 bp, Homo sapiens
aaacggaatcaaacggaattatcgaatggaatcgaagagaatcatcgaatggactcgaatggaatcatctaatggaatggaatggaagaatccatgg

SEQ ID NO: 6918 - DNA, 87 bp, Homo sapiens
atacacaaatcaataaatgtaatccagcatataaacagaaccaaagacaaaaaccatatgattatctcaatggatgcagaaaaggcc

SEQ ID NO: 6919 - DNA, 61 bp, Homo sapiens
aatcgaatagaatcatcgaatggactcgaatggaatcatcgaatgtaatgatggaacagtc

SEQ ID NO: 6920 - DNA, 124 bp, Homo sapiens
tggaatggaatcatcgcatagaatcgaatggaattaccatcgaatgggatcgaatggtatcaacatcaaacgcaaaaaaacggaattatcgaatggaatcgaagagaatcttcgaacggacccg

SEQ ID NO: 6921 - DNA, 63 bp, Homo sapiens
atggaatggaatggaatggaattaaatggaatggaaaggaatggaatcgaatggaaaggaatc

SEQ ID NO: 6922 - DNA, 102 bp, Homo sapiens
gtcgaaatgaatagaatgcaatcatcatcaaatggaatccaatggaatcatcatcaaatagaatcgaatggaatcatcaaatggaatcgaatggagtcattg

SEQ ID NO: 6923 - DNA, 77 bp, Homo sapiens
tggaattatcgaaagcaaacgaatagaatcatcgaatggactcgaatggaatcatcgaatggaatggaatggaacag

SEQ ID NO: 6924 - DNA, 69 bp, Homo sapiens
aaaggaatggaatgcaatggaatgcaatggaatgcacaggaatggaatggaatggaatggaaaggaatg

SEQ ID NO: 6925 - DNA, 75 bp, Homo sapiens
aatctaatggaatcaacatcaaacggaaaaaaacggaattatcgaatggaatcgaagagaatcatcgaatggacc

SEQ ID NO: 6926 - DNA, 100 bp, Homo sapiens
tacacaacaaaagaaatactcaacacagtaaacagacaaccttcagaacaggagaaaatatttgcaaatacatctaacaaagggctaatatccagaatct

SEQ ID NO: 6927 - DNA, 70 bp, Homo sapiens
tgcaatcctagtctcagataaaacagacattaaaccaacaaagatcaaaagagacaaagaaggccattac

SEQ ID NO: 6928 - DNA, 76 bp, Homo sapiens
gaatcgaatggaatcaacatcaaacggaaaaaaacggaattatcgaatggaatcgaaaagaatcatcgaatggacc

SEQ ID NO: 6929 - DNA, 85 bp, Homo sapiens
aatggaatcgaatggaatgcaatccaatggaatggaatgcaatgcaatggaatggaatcgaacggaatgcagtggaagggaatgg

SEQ ID NO: 6930 - DNA, 102 bp, Homo sapiens
gaacacagaaaaatttcaaaggaataatcaacagggattgataactaactggatttagagagccaaggcaaagagaatcaaagcacagggcctgagtcggag

SEQ ID NO: 6931 - DNA, 81 bp, Homo sapiens
agttgaatagaaccaatccgaatgaaatggaatggaatggaacggaatggaattgaatggaatggaatggaatgcaatgga

SEQ ID NO: 6932 - DNA, 90 bp, Homo sapiens
aactcgattgcaatggaatgtaatgtaatggaatggaatggaattaacgcgaatagaatggaatggaatgtaatggaacggaatggaatg

SEQ ID NO: 6933 - DNA, 82 bp, Homo sapiens
aagcggaatagaattgaatcatcattgaatggaatcgagtagaatcattgaaatcgaatggaatcatagaatggaatccaat

SEQ ID NO: 6934 - DNA, 94 bp, Homo sapiens
aatggaatcgaaaggaatagaatggaatggatcgttatggaaagatatcgaatggaatggaattgactcgaatggaatggactggaatggaacg

SEQ ID NO: 6935 - DNA, 91 bp, Homo sapiens
taacggaataatcatcgaacagaatcaaatggaatcatcattgaatggaattgaatggaatcttcgaatagacatgaatggaccatcatcg

SEQ ID NO: 6936 - DNA, 87 bp, Homo sapiens
aacggaatcaaacggaattatcgaatggaatcgaatagaatcatcgaacggactcgaatggaatcatctaatggaatggaatggaag

SEQ ID NO: 6937 - DNA, 84 bp, Homo sapiens
attggaatggaacggaacagaacggaatggaatggaatagaatggaatggaatggaatggtatggaatggaatggaatggtacg

SEQ ID NO: 6938 - DNA, 87 bp, Homo sapiens
aatccacaaagacaacagaagaaaagacaacagtagacaaggatgtcaaccacattttggaagagacaagtaatcaaacacatggca

SEQ ID NO: 6939 - DNA, 118 bp, Homo sapiens
gaatcgaatggaatcaacatcaaacggaaaaaaacggaattatcgaatggaatcgaaaagaatcatcgaacggactcgaatggaatcatctaatggaatggaatggaagaatccatgg

SEQ ID NO: 6940 - DNA, 73 bp, Homo sapiens
aatggaatcgaatggaatcatcatcaaatggaatctaatggaatcattgaacggaattggatggaatcgtcat

SEQ ID NO: 6941 - DNA, 62 bp, Homo sapiens
caacatcaaacggaaaaaaacggaattatcgaatggaatcgaagagaatcatcgaatggacc

SEQ ID NO: 6942 - DNA, 82 bp, Homo sapiens
cacaaccaaagcaatgaaagaaaagcacagacttattgaaatgaaagtacacaccacagaatgggagcaggctcaagcaagc

SEQ ID NO: 6943 - DNA, 103 bp, Homo sapiens
atcaaagggaatcaagcggaattatcgaatggaatcgaagagaatcatcgaatggactcgaatggaatcatgtgatggaatggaatggaataatccacggact

SEQ ID NO: 6944 - DNA, 77 bp, Homo sapiens
ggaatcgaatggaatcaatatcaaacggagaaaaacggaattatcgaatggaatcgaagagaatcatcgaatggacc

SEQ ID NO: 6945 - DNA, 73 bp, Homo sapiens
aggaatggacacgaacggaatgcaatcgaatggaatggaatctaatagaaaggaattgaatgaaatggactgg

SEQ ID NO: 6946 - DNA, 82 bp, Homo sapiens
ggaagggaatcaaatgcaacagaatgtaatggaatggaatgcaatggaatgcaatggaatggaatggaatgcaatggaatgg

SEQ ID NO: 6947 - DNA, 133 bp, Homo sapiens
aaattggattgaatcgaatcgaatggaaaaaatgaaatcaaatgaaattgaatggaatcgaaatgaatgtaaacaatggaatccaatggaatccaatggaatcgaatcaaatggttttgagtggcgtaaaatg

SEQ ID NO: 6948 - DNA, 85 bp, Homo sapiens
aatggaagggaatggaatggaatcgaatcgaatggaacagaattcaatggaatggaatggaatggaatggaatcgaatggaatgg

SEQ ID NO: 6949 - DNA, 86 bp, Homo sapiens
gaaaaatcattgaacggaatcgaatggaatcatcatcggatggaaacgaatggaatcatcatcgaatggaaatgaaaggagtcatc

SEQ ID NO: 6950 - DNA, 77 bp, Homo sapiens
ggaatcgaatggaatcaacatcaaacggagaaaaacggaattatcgaatggaatcgaagagaatcatcgaatggacc

SEQ ID NO: 6951 - DNA, 93 bp, Homo sapiens
aaagaaatgtcactgcgtatacacacacacgcacatacacacaccatggaatactactcagctatacaaaggaatgaaataatccacagccac

SEQ ID NO: 6952 - DNA, 77 bp, Homo sapiens
ggaatcgaatggaatcaatatcaaacggaaaaaaacggaattatcgaatggaatcgaagagaatcatcgaatggacc

SEQ ID NO: 6953 - DNA, 76 bp, Homo sapiens
tgaacggaatcgaatggaatcatcatcggatggaaacgaatggaatcatcatcgaatggaaatgaaaggagtcatc

SEQ ID NO: 6954 - DNA, 60 bp, Homo sapiens
gaatagaacgaaatggaatggaatggaatggaatggaaaggaatggaatggaatggaacg

SEQ ID NO: 6955 - DNA, 136 bp, Homo sapiens
tggaattatcgtcgaatagaatcgaatggtatcaacatcaaacggaaaaaaacggaattatcgaatggaatcgaagagaatcatcgaacggactcgaatggaatcatctaatggaatggaatggaataatccatgg

SEQ ID NO: 6956 - DNA, 124 bp, Homo sapiens
gacaaaaagaatcatcatcgaatagaatcaaatggaatctttgaatggactcaaaaggaatatcgtcaaatggaatcaaaagccatcatcgaatggactgaaatggaattatcaaatggactcg

SEQ ID NO: 6957 - DNA, 97 bp, Homo sapiens
aaccaaaccaagcaaacaaacaaacagtaaaaactcaataacaaccaacaaacaggaaataccaggtaattcagattatctagttatgtgccatagt

SEQ ID NO: 6958 - DNA, 148 bp, Homo sapiens
gaatgaattgaatgcaaacatcgaatggtctcgaatggaatcatcttcaaatggaatggaatggaatcatcgcatagaatcgaatggaattatcaacgaatggaatcgaatggaatcatcatcagatggaaatgaatggaatcgtcat

SEQ ID NO: 6959 - DNA, 97 bp, Homo sapiens
tggaatggaatcaaatcgcatggaatcgaatggaatagaaaagaatcaaacagagtggaatggaatggaatggaatggaatcatgccgaatggaatg

SEQ ID NO: 6960 - DNA, 148 bp, Homo sapiens
aaatggaataatgaaatggaatcgaacggaatcatcatcaaaaggaaccgaatgaagtcattgaatggaatcaaaggcaatcatggtcgaatggaatcaaatggaaacagcattgaatagaattgaatggagtcatcacatggaatcg

SEQ ID NO: 6961 - DNA, 80 bp, Homo sapiens
gaattaacccgaatagaatggaatggaatggaatggaacagaacggaacggaatggaatggaatggaatggaatggaatg

SEQ ID NO: 6962 - DNA, 109 bp, Homo sapiens
aagatatacaagcagccaacaaacatacgaaagaatgctcaacatcactaatcctcagagaaatttaaatcaaaaccacaatgagttacaatctcataccagtcagaat

SEQ ID NO: 6963 - DNA, 94 bp, Homo sapiens
agataagtggatgaacagatggacagatggatggatggatggatggatggatggatgcctggaagaaagaagaatggatagtaagctgggtata

SEQ ID NO: 6964 - DNA, 106 bp, Homo sapiens
agaattacaaaccactgctcaacaaaataaaagagtacacaaacaaatggaagaatattccatgcttatggataggaagaatcaatattgtgaaaatggccatact

SEQ ID NO: 6965 - DNA, 93 bp, Homo sapiens
catcgaatggactcgaatggaataatcattgaacggaatcgaagggaatcatcatcggatggaaacgaatggaatcatcatcgaatggaaatg

SEQ ID NO: 6966 - DNA, 105 bp, Homo sapiens
aaaggaatcaaacggaattatcgaatggaatcgaaaagaatcatcgaacggactcgaatggaatcatctaatggaatggaatggaagaatccatggactcgaatg

SEQ ID NO: 6967 - DNA, 92 bp, Homo sapiens
ggatataaacaagaaaacaactaatcacaactcaatatcaaagtgcaatgatggtgcaaaatgcaagtatggtggggacagagaaaggatgc

SEQ ID NO: 6968 - DNA, 61 bp, Homo sapiens
aacatcaaacggaaaaaaacggaaatatcgaatggaatcgaagagaatcatcgaatggacc

SEQ ID NO: 6969 - DNA, 76 bp, Homo sapiens
taaaatggaatcgaatggaatcaacatcaaatggaatcaaatggaatcattgaacggaattgaatggaatcgtcat

SEQ ID NO: 6970 - DNA, 84 bp, Homo sapiens
aatcatcatcgaatggaatcgaatggtatcattgaatggaatcgaatggaatcatcatcagatggaaatgaatggaatcgtcat

SEQ ID NO: 6971 - DNA, 64 bp, Homo sapiens
caatgcgtcaagctcagacgtgcctcactacggcaatgcgtcaagctcaggcgtgcctcactat

SEQ ID NO: 6972 - DNA, 101 bp, Homo sapiens
taagctgataagcaactttagcaaagtctcaggatacaaaatcaatgtacaaaaatcacaagcattcttatacaccaacaacagacagacggagagccaaa

SEQ ID NO: 6973 - DNA, 55 bp, Homo sapiens
aatcaaagaattgaatcgaatggaatcatctaatgtactcgaatggaatcaccat

SEQ ID NO: 6974 - DNA, 114 bp, Homo sapiens
atgaacacgaatgtaatgcaatccaatagaatggaatcgaatggcatggaatataaagaaatggaatcgaagagaatggaaacaaatggaatggaattgaatggaatggaattg

SEQ ID NO: 6975 - DNA, 88 bp, Homo sapiens
atcaaacggaatcaaacggaattatcgaatggaatcgaagagaatcatcgaacggactcgaatggaatcatctaatggaatgggatgg

SEQ ID NO: 6976 - DNA, 94 bp, Homo sapiens
aatggaaaggaatcaaatggaatataatggaatgcaatggactcgaatggaatggaatggaatggacccaaatggaatggaatggaatggaatg

SEQ ID NO: 6977 - DNA, 91 bp, Homo sapiens
ggaatacaacggaatggaatcgaaaaaaatggaaaggaatgaaatgaatggaatggaatggaatggaatggatgggaatggaatggaatgg

SEQ ID NO: 6978 - DNA, 95 bp, Homo sapiens
gaatcaagcggaattatcgaatggaatcgaagagaatcatcgaaaggactcgaatggaatcatctaatggaatggaatggaataatacacggacc

SEQ ID NO: 6979 - DNA, 98 bp, Homo sapiens
aagataacctgtgcccaggagaaaaacaatcaatggcaacaaaagcagaaacaacacaaatgatacaattagcagacagaaacattgagattgctatt

SEQ ID NO: 6980 - DNA, 88 bp, Homo sapiens
aatggactccaatggaataatcattgaacggaatctaatggaatcatcatcggatggaaatgagtggaatcatcatcgaatggaatcg

SEQ ID NO: 6981 - DNA, 79 bp, Homo sapiens
aatctataaacgtaatccatcacataaacaggaccaaagagaaaaaccgcatgattatctcaagaatgcagaaaaggcc

SEQ ID NO: 6982 - DNA, 95 bp, Homo sapiens
taattgattcgaaattaatggaattgaatggaatgcaatcaaatggaatggaatgtaatgcaatggaatgtaatagaatggaaagcaatggaatg

SEQ ID NO: 6983 - DNA, 78 bp, Homo sapiens
aaaggaatggacttgaacaaaatgaaatcgaacgataggaatcgtacagaacggaaagaaatggaacggaatggaatg

SEQ ID NO: 6984 - DNA, 94 bp, Homo sapiens
tgagcagggaacaatgcggataaatttcacaaatacaatgttgagcaaaagaaagacacaaaagaatacacacatacacaccatatgggctagg

SEQ ID NO: 6985 - DNA, 79 bp, Homo sapiens
aatggaatcgaacggaatcatcatcaaacggaaccgaatggaatcattgaatggaatcaaaggcaatcatggtcgaatg

SEQ ID NO: 6986 - DNA, 85 bp, Homo sapiens
aatggaatggaatgtacaagaaaggaatggaatgaaaccgaatggaatggaatggacgcaaaatgaatggaatggaagtcaatgg

SEQ ID NO: 6987 - DNA, 54 bp, Homo sapiens
aacggaaaaaaacggaattatcgaatggaatcgaagagaatcatcgaatggacc

SEQ ID NO: 6988 - DNA, 87 bp, Homo sapiens
ggaataatcattgaacggaatcgaatggaatcatcatcggatggaaacgaatggaatcatcatcgaatggaaatgaaaggagtcatc

SEQ ID NO: 6989 - DNA, 82 bp, Homo sapiens
ggaacgaaatcgaatggaacggaatagaatagactcgaatgtaatggattgctatgtaattgattcgaatggaatggaatcg

SEQ ID NO: 6990 - DNA, 80 bp, Homo sapiens
tgaaaggaatagactggaacaaaatgaaatcgaatggtaggaatcatacagaacagaaagaaatggaacggaatggaatg

SEQ ID NO: 6991 - DNA, 75 bp, Homo sapiens
aacccgaatagaatggaatggaatggaatggaacggaacggaatggaatggaatggattggaatggaatggaatg

SEQ ID NO: 6992 - DNA, 90 bp, Homo sapiens
aaagagaatcaaatggaattgaatcgaatggaatcgaatggattggaaaggaatagaatggaatggaatggaatggaatggaatggaatg

SEQ ID NO: 6993 - DNA, 70 bp, Homo sapiens
aatggaatcatcagtaatggaatggaaaggaatggaaaggactggaatggaatggaatggaatggaatgg

SEQ ID NO: 6994 - DNA, 116 bp, Homo sapiens
ggaacaaaatgaaatcgaacggtaggaatcgtacagaacggaaagaaatggaacggaatggaatgcactcaaatggaaaggagtccaatggaatcgaaaggaatagaatggaatgg

SEQ ID NO: 6995 - DNA, 132 bp, Homo sapiens
agaatgagatcaagcagtataataaaggaagaagtagcaaaattacaacagagcagtgaaatggatatgctttctggcaataattgtgaaaggtctggtaatgagaaagtagcaacagctagtggctgccac

SEQ ID NO: 6996 - DNA, 98 bp, Homo sapiens
aacaaatggaatcaacatcgaatggaatcgaatggaaacaccatcgaattgaaacgaatggaattatcatgaaattgaaatggatggactcatcatcg

SEQ ID NO: 6997 - DNA, 125 bp, Homo sapiens
taacatgcagcatgcacacacgaatacacaacacacaaacatgtatgcacgcacacgtgaatacacaacacacacaaacatgcatgcatgcatacatgaatacacagcacacaaatatccagcat

SEQ ID NO: 6998 - DNA, 72 bp, Homo sapiens
gaatggaatcaacatcaaacggaaaaaaaacggaattatcgaatggaatcgaatagaatcatcgaatggacc

SEQ ID NO: 6999 - DNA, 98 bp, Homo sapiens
aatcgaatgaaatggagtcaaaaggaatggaatcgaatggcaagaaatcgaatgtaatggaatcgcaaggaattgatgtgaacggaacggaatggaat

SEQ ID NO: 7000 - DNA, 91 bp, Homo sapiens
aatggaattgaacggaaacatcagcgaatggaatcgaaaggaatcatcatggaatagattcgaatggaatggaaaggaatggaatggaatg

SEQ ID NO: 7001 - DNA, 132 bp, Homo sapiens
atggaatcaacatcaaacagaatcaaacggaattatcgaatggaatcgaagacaatcatcgaatggactcgaatggaatcatctaatggaatggaatggaagaatccatggtctcgaatgcaatcatcatcg

SEQ ID NO: 7002 - DNA, 86 bp, Homo sapiens
gaataatcattgaacggaatcgaatggaatcatcttcggatggaaacgaatggaatcatcatcgaatggaaatgaaaggagtcatc

SEQ ID NO: 7003 - DNA, 88 bp, Homo sapiens
aatggactcgaatggaataatcattgaacggaatcgaatggaatcatcatcggatggaaatgagtggaatcatcatcgaatggaatcg

SEQ ID NO: 7004 - DNA, 98 bp, Homo sapiens
aaatgaaatcgaacggtaggaatcgtacagaacggaaagaaatggaacggaatggaatgcaatcgaatggaaaggagtccaatggaagggaatcgaat

SEQ ID NO: 7005 - DNA, 93 bp, Homo sapiens
taccaaacatttaaagaacaaatatcaatcctacgcaaaccattctgaaacacagagatggaggatatacagcgaaactcattctacatggcc

SEQ ID NO: 7006 - DNA, 106 bp, Homo sapiens
tattggaatggaatggaatggagtcgaatggaacggaatgcactcgaatggaaggcaatgcaatggaatgcactcaacaggaatagaatggaatggaatggaatgg

SEQ ID NO: 7007 - DNA, 64 bp, Homo sapiens
ggaatttaatagaatgtacccgaatggaacggaatggaatggaattgtatggcatggaatggaa

SEQ ID NO: 7008 - DNA, 97 bp, Homo sapiens
gcaatccaatagaatggaatcgaatggcatggaatataaagaaatggaatcgaagagaatggagacaaatggaatggaattgaatggaatggaattg

SEQ ID NO: 7009 - DNA, 118 bp, Homo sapiens
aatggaatcgaatggaatcatcatcaaatggaatctaatggaatcattgaacggaattaaatggaatcgtcatcgaatgaattcaatgcaatcaacgaatggtctcgaatggaaccac

SEQ ID NO: 7010 - DNA, 106 bp, Homo sapiens
aattgcaaaagaaacacacatatacacatataaaactcaagaaagacaaaactaacctatggtgatagaaatcagaaaagtacagtacattggttgtcttggtggg

SEQ ID NO: 7011 - DNA, 89 bp, Homo sapiens
tgacatcattattatcaagaaacattcttaccactgttaccaacttcccaacacagactatggagagagagataagacagaatagcatt

SEQ ID NO: 7012 - DNA, 89 bp, Homo sapiens
aaagaattgaattgaatagaatcaccaatgaattgaatcgaatggaatcgtcatcgaatggaatcgaagggaatcattggatgggctca

SEQ ID NO: 7013 - DNA, 87 bp, Homo sapiens
atcatcgaatggaatcgaatggaatcaatatcaaacggaaaaaaacggaattatcgaatggaatcgaatagaatcatcgaatggacc

SEQ ID NO: 7014 - DNA, 83 bp, Homo sapiens
gaatgaaatcgtatagaatcatcgaatgcaactgaatggaatcattaaatggacttgaaaggaattattatggaatggaattg

SEQ ID NO: 7015 - DNA, 90 bp, Homo sapiens
taagcaacttcagcaaagtctcaggatacaaaatcaatgtgcaaaaatctcaagcattcttatacacgaacaacagacaaacagagagct

SEQ ID NO: 7016 - DNA, 79 bp, Homo sapiens
actcaaaaggaattgattcgaatggaatagaatggcaaggaatagtattgaattgaatggaatggaatggacccaaatg

SEQ ID NO: 7017 - DNA, 95 bp, Homo sapiens
gaatggaatttaaaggaatagaatggaaggaatcggatggaatggaatggaatagaatggagtcgaatggaatagaatcgaatggaatggcattg

SEQ ID NO: 7018 - DNA, 124 bp, Homo sapiens
tgagaaaatgatggaaaagaggaataaaacgaaacaaaaccacaggaacacaggtgcatgtgaatgtgcacagacaaagatacagggcggactgggaaggaagtttctgcaccagaatttgggg

SEQ ID NO: 7019 - DNA, 86 bp, Homo sapiens
aacaaaaaatgagtcaagccttaaataaaatcagagccaaaaaagaagacattacatctgataagacaaaaattcaaaggaccatc

SEQ ID NO: 7020 - DNA, 96 bp, Homo sapiens
aacccagtggaattgaattgaatggaattgaatggaatggaaagaatcaatccgagtcgaatggaatggtatggaatggaatggcatggaatcaac

SEQ ID NO: 7021 - DNA, 65 bp, Homo sapiens
atcaacatcaaacggaaaaaaaacggaattatcgaatggaatcgaagagaatcatcgaatggacc

SEQ ID NO: 7022 - DNA, 92 bp, Homo sapiens
aaggaatggaatggtacggaatagaatggaatggaacgaattgtaatggaatggaatttaatggaacggaatggaatggaatggaatcaacg

SEQ ID NO: 7023 - DNA, 66 bp, Homo sapiens
aacggaatggaaagcaatttaatcaaatgcaatacagtggaattgaagggaatggaatggaatggc

SEQ ID NO: 7024 - DNA, 150 bp, Homo sapiens
aatcgaatggaacggaatagaatagactcgaatgtaatggattgctatgtaattgattcgaatggaatggaatcgaatggaatgcaatccaatggaatggaatgcaatgcaatggaatggaatcgaacggaatgcagtggaagggaatgg

SEQ ID NO: 7025 - DNA, 87 bp, Homo sapiens
tagcaacattttagtaacatgatagaaacaaaacagcaacatagcaatgcaatagtaacacaacagcaacatcataacatggcagca

SEQ ID NO: 7026 - DNA, 79 bp, Homo sapiens
aatggaatcgaagagaatggaaacaaatggaatggaattgaatggaatggaattgaatggaatgggaaggaatggagtg

SEQ ID NO: 7027 - DNA, 136 bp, Homo sapiens
agcaaacaagtgaataaacaagcaaacaagtgaacaagcaaacaagtgaataaacaagcaaacaagtgaacaagcaaacaagtgaataaacaagcaaacaagtgaacaaggaaacaagtgaataaacaaaggctct

SEQ ID NO: 7028 - DNA, 94 bp, Homo sapiens
aatggaatcaacacgagtgcaattgaatggaatcgaatggaatggaatggaatggaatgaattcaacccgaatggaatggaaaggaatggaatc

SEQ ID NO: 7029 - DNA, 76 bp, Homo sapiens
gaatcgaatggaatcaacatcaaacggaaaaaaacggaattatcgaatggaatcgaagagaatcatcgaatggacc

SEQ ID NO: 7030 - DNA, 141 bp, Homo sapiens
aacacgaatgtaatgcaatccaatagaatggaatcgaatggcatggaatataaagaaatggaatcgaagagaatggaaacaaacggaatggaattgaatggaatggaattgaatggaatgggaacgaatggagtgaaattg

SEQ ID NO: 7031 - DNA, 146 bp, Homo sapiens
gaatggaacggaatagaacagactcgaatgtaatggattgctatgtaattgattcgaatggaatggaatcgaatggaatgcaatccaatggaatggaatgcaatgcaatggaatggaatcgaatggaatgcagtggaagggaatgg

SEQ ID NO: 7032 - DNA, 76 bp, Homo sapiens
gaatcgaatggaatcaatatcaaacggaaaaaaacggaattatcgaatggaatcgaagagaatcatcgaatggacc

SEQ ID NO: 7033 - DNA, 136 bp, Homo sapiens
ataaacatcaaacggaatcaaacggaattatcgaatggaatcgaagagaataatcgaatggactcaaatggagtcatctaatggaatggtatggaagaatccatggactccaacgcaatcatcagcgaatggaatc

SEQ ID NO: 7034 - DNA, 101 bp, Homo sapiens
aaaagaaaagacaaaagacaccaattgccaatactgaaatgaaaaaacaggtaataactattgatcccatggacattaaaatgatgttgaaggaacaccac

SEQ ID NO: 7035 - DNA, 76 bp, Homo sapiens
aatgtcaagtggaatcgagtggaatcatcgaaagaaatcgaatggaatcgaagggaatcattggatgggctcaaat

SEQ ID NO: 7036 - DNA, 87 bp, Homo sapiens
atcatcgaatggaatagaatggtatcaacatcaaacggagaaaaacggaattatcgaatggaatcgaagagaatcttcgaacggacc

SEQ ID NO: 7037 - DNA, 122 bp, Homo sapiens
gaatggaatcatcgcatagaatcggatggaattatcatcgaatggaatcgaatggtatcaacatcaaacggaaaaaaacggaattatcgaatggaatcgaattgaatcatcgaacggacccg

SEQ ID NO: 7038 - DNA, 133 bp, Homo sapiens
aatggactcgaatggaataatcattgaacggaatcgaatggaatcatcatcggatggaaatgaatggaataatccatggactcgaatgcaatcatcatcgaatggaatcgaatggaatcatcgaatggactcg

SEQ ID NO: 7039 - DNA, 70 bp, Homo sapiens
aatgcaatcatcaactggcttcgaatggaatcatcaagaatggaatcgaatggaatcatcgaatggactc

SEQ ID NO: 7040 - DNA, 68 bp, Homo sapiens
aagagaccaataaggaataagtaagcaacaagaggaaggagaaaagggcaagagagatgaccagagtt

SEQ ID NO: 7041 - DNA, 87 bp, Homo sapiens
tggaatcatcataaaatggaatcgaatggaatcaacatcaaatggaatcaaatggaatcattgaacggaattgaatggaatcgtcat

SEQ ID NO: 7042 - DNA, 117 bp, Homo sapiens
ggaatcatcgcatagaatcgaatggaattatcatcgaatggaatcgaatggaatcaacatcaaacgaaaaaaaaccggaattatcgaatggaatcgaagagaatcatcgaacggacc

SEQ ID NO: 7043 - DNA, 85 bp, Homo sapiens
aaatcatcatcgaatgggatcgaatggtatccttgaatggaatcgaatggaatcatcatcagatggaaatgaatggaatcgtcat

SEQ ID NO: 7044 - DNA, 104 bp, Homo sapiens
ggaatgtaatagaacggaaagcaatggaatggaacgcactggattcgagtgcaatggaatctattggaatggaatcgaatggaatggtttggcatggaatggac

SEQ ID NO: 7045 - DNA, 84 bp, Homo sapiens
aaacaatggaagataatggaaagatatcgaatggaatagaatggaatggaatggactcaaatggaatggactttaatggaatgg

SEQ ID NO: 7046 - DNA, 148 bp, Homo sapiens
ggaacgaaatcgaatggaacggaatagaatagactcgaatgtaatggattgctatgtaattgattcgaatggaatggaatcgaatggaatgcaatccaatggaatggaatgcaatgcaatgaatggaatggaatggaatggaatggaa

SEQ ID NO: 7047 - DNA, 85 bp, Homo sapiens
aaaccgaatggaatggaatggacgcaaaatgaatggaatggaagtcaatggactcgaaatgaatggaatggaatggaatggaatg

SEQ ID NO: 7048 - DNA, 77 bp, Homo sapiens
ggaatcgaatggaatcaacatcaaacggaaaaaaacagaattatcgtatggaatcgaatagaatcatcgaatggacc

SEQ ID NO: 7049 - DNA, 96 bp, Homo sapiens
caacccgagtggaataaaatggaatggaatggaatgaaatggaatggatcggaatggaatccaatggaatcaactggaatggaatggaatggaatg

SEQ ID NO: 7050 - DNA, 88 bp, Homo sapiens
tatcatcgaatggaatcgaatggaatcaacatcaaacggaaaaaaacggaattatcgaatggaatcgaagagaatcatcgaatggacc

SEQ ID NO: 7051 - DNA, 88 bp, Homo sapiens
cggaataatcattgaacggaatcgaatggaatcatcatcggatggaaacgaatggaatcatcatcgaatggaaatgaaaggagtcatc

SEQ ID NO: 7052 - DNA, 83 bp, Homo sapiens
caacacacagagattaaaacaaacaaacaaacaatccagccctgacatttatgagtttacagactggtggagaggcagagaag

SEQ ID NO: 7053 - DNA, 71 bp, Homo sapiens
cactacaaaccacgctcaaggcaataaaagaacacaaacaaatggaaaaacattccatgctcatggatggg

SEQ ID NO: 7054 - DNA, 75 bp, Homo sapiens
aatcgaatggaattaacatcaaacggaaaaaaacggaattatcgaatggaatcgaagagaatcatcgaatggacc

SEQ ID NO: 7055 - DNA, 82 bp, Homo sapiens
tggaaaagaatcaaattgaatggcatcgaacggaatgggatggaatggaatagacccagatgtaatggactcgaatggaatg

SEQ ID NO: 7056 - DNA, 95 bp, Homo sapiens
gactaatattcagaatatacaaggaactcaaacaactcaacagtagaaaaaaaaacctgaatagacatttctcaaaagaagacatacaaatggcc

SEQ ID NO: 7057 - DNA, 67 bp, Homo sapiens
ggtccattcgatgattctcttcgattccattcgataattccgttttttcccgtttgatgttgattcc

SEQ ID NO: 7058 - DNA, 147 bp, Homo sapiens
ggaacgaaatcgaatggaacggaatagaatagactcgaatgtaatggattgctatgtaattgattcgaatggaatggaatcgaatggaatgcaatccaatggaatggaatgcaatgcaatgaatggaatggaatggaatggaatgga

SEQ ID NO: 7059 - DNA, 91 bp, Homo sapiens
agcaacttcagtaaagtgtcaggatacaaaatcaatgtgcaaaaatcacaagcattcttatacatcaataacagacaaacagagagccaaa

SEQ ID NO: 7060 - DNA, 86 bp, Homo sapiens
gaataatcattgaacggaatcgaatggaatcatcatcggatggaaacgaatggaatcatcatcgaatggaaatgaaaggagtcatc

SEQ ID NO: 7061 - DNA, 66 bp, Homo sapiens
taatcatcttcgaattgaaaacaaagcaatcattaaatgtactctaacggaatcatcgaatggacc

SEQ ID NO: 7062 - DNA, 77 bp, Homo sapiens
ggaatcgaatggaatcaacatcaaacggaaaaaaacggaattatcgaatggaatcgaagagaatcatcgaatggacc

SEQ ID NO: 7063 - DNA, 86 bp, Homo sapiens
agagaaaagatgatcatgtaaccattgaaaagacaatgtacaaaactaatactaatcacacaggaccagaaagcaatttagaccat

SEQ ID NO: 7064 - DNA, 79 bp, Homo sapiens
aatggaatcgaatggaatcaacatcaaacggaaaaaacggaattatcgaatggaatcaaagagaatcatcgaatggacc

SEQ ID NO: 7065 - DNA, 96 bp, Homo sapiens
aatggaattatcatcgaatggaatcgaatggaatcaacatcaaacggaaaaaaacggaattatcgaatggaatcgaagagaatcatcgaatggacc

SEQ ID NO: 7066 - DNA, 149 bp, Homo sapiens
gtcaacacaggaccaacataggaccaacacagggtcaacacaggaccaacataggaccaacacagggtcaacacaagaccaacatgggaccaacacagggtcaacataggaccaacatgggaccaacacagggtcaacacaggaccaac

SEQ ID NO: 7067 - DNA, 79 bp, Homo sapiens
gaatcaactcgattgcaatcgaatggaatggaatggtattaacagaatagaatggaatggaatggaatggaacggaacg

SEQ ID NO: 7068 - DNA, 105 bp, Homo sapiens
actcgaatgcaatcaacatcaaacggaatcaaacggaattatcgaatggaatcgaagagaatcatcgaacggactcgaatggaatcatctaatggaatggaatgg

SEQ ID NO: 7069 - DNA, 86 bp, Homo sapiens
aatggaatggaataatcgacggacccgaatgcaatcatcatcgtacagaatcgaatggaatcatcgaatggactggaatggaatgg

SEQ ID NO: 7070 - DNA, 106 bp, Homo sapiens
aatacaaaccactgctcaacgaaataaaagaggatacaaacaaatggaagaacattctatgctcatgggtaggatgaattcatatcgtgaaaatggccatactgcc

SEQ ID NO: 7071 - DNA, 142 bp, Homo sapiens
aaacacgcaaacacacacacaagcacactaccacacaagcggacacacatgcaaacacgcgaacacacacacatatacacacaagcacattacaaaacacaagcaaacaccagcagacacacaaacacacaaacatacatgg

SEQ ID NO: 7072 - DNA, 76 bp, Homo sapiens
aatcgaacggaatcaacatcaaacggaaaaaaaacggaattatcgaatggaatcgaagagaatcatcgaatggacc

SEQ ID NO: 7073 - DNA, 81 bp, Homo sapiens
taattgattcgaatggaatggaatagaatggaattgaatggaatggaccataatggattggactttaatagaaagggcatg

SEQ ID NO: 7074 - DNA, 88 bp, Homo sapiens
agcaacttcagcaaagtctcaggatacaaaatcaatgtacaaaagtcacaagcattcttatacaccaacaaaagacaaacagagagcc

SEQ ID NO: 7075 - DNA, 68 bp, Homo sapiens
acatcaaacggaaaaaaaaaacaaaacggaattatcgaatggaatcgaagagaatcatcgaatggacc

SEQ ID NO: 7076 - DNA, 81 bp, Homo sapiens
gaaattccaattaaaatgaaatcgacttatcttaacaaatatagcaatgctgacaacacttctccggatatgggtactgct

SEQ ID NO: 7077 - DNA, 92 bp, Homo sapiens
acatctcacttttagtaatgaacagatcattcagacagaaaattagcaaagaaacatcagagttaaactacactctaaaccaaatggaccta

SEQ ID NO: 7078 - DNA, 88 bp, Homo sapiens
gaagaaagcattcattcaagacatctaactcgttgatataatgcatacagttcaaaatgattacactatcattacatctagggctttc

SEQ ID NO: 7079 - DNA, 62 bp, Homo sapiens
acacacacattcaaagcagcaatatttacaacagccaaaaggtggaaacaattgagcaattg

SEQ ID NO: 7080 - DNA, 87 bp, Homo sapiens
atcatcgaatagaatcgaatggtatcaacaccaaacggaaaaaaacggaattatcgaatggaatcgaagagaatcttcgaacggacc

SEQ ID NO: 7081 - DNA, 63 bp, Homo sapiens
atcaacatcaaacggaaaaaacggaattatcgaatggaatcgaagagaatcatcgaacggacc

SEQ ID NO: 7082 - DNA, 92 bp, Homo sapiens
aatcgaaaggaatgtcatcgaatggaatggactcaaatggaatagaatcggatggaatggcatcgaatggaatggaatggaattggatggac

SEQ ID NO: 7083 - DNA, 138 bp, Homo sapiens
aacatgaacagtggaacaatcagtgaaccaatacaagggttaaataagctagcaattaaaagctgtatcactggtctaaagatagaagatcaagtagaaaatcagcgcaagaggaaagatatacgaaaactaatggcc

SEQ ID NO: 7084 - DNA, 123 bp, Homo sapiens
cgaatggaatcattatggaatggaatgaaatggaataatcaaatggaattgaatggaatcatcgaatggaatcgaacaaaatcctctttgaatggaataagatggaatcaccaaatggaattg

SEQ ID NO: 7085 - DNA, 79 bp, Homo sapiens
aagggaattgaatagaatgaatccgaatggaatggaatggaatggaatggaatggaatggaatggaatggaatggaatg

SEQ ID NO: 7086 - DNA, 84 bp, Homo sapiens
gaatggaatcgaatcaaattaaatcaaatggaatgcaatagaagggaatacaatggaatagaatggaatggaatggaatggact

SEQ ID NO: 7087 - DNA, 100 bp, Homo sapiens
aaacggaatcaaacggaattatcgaatggaatcgaagagaatcatcgaacggactcgaatggaatcatctaatggaatggaatggaagaatccatggact

SEQ ID NO: 7088 - DNA, 101 bp, Homo sapiens
atggaatcaacatcaaacggaaaaaaaaacggaattatcgaatggaatcgaagagaatcatcgaatggaccagaatggaatcatctaatggaatggaatgg

SEQ ID NO: 7089 - DNA, 88 bp, Homo sapiens
aatggaatcatcatcgaatggaatcgaatggaatcatggaatggaatcaaatggaatcaaatggaatcgaatggaatggaatggaatg

SEQ ID NO: 7090 - DNA, 87 bp, Homo sapiens
aacggaatcaaacggaattaccgaatggaatcgaatagaatcatcgaacggactcgaatggaatcatctaatggaatggaatggaag

SEQ ID NO: 7091 - DNA, 97 bp, Homo sapiens
aaacggaatcaaacggaattatcgaatggaatcgaaaagaatcatcgaacggactcgaatggaatcatctaatggaatggaatggaagaatccatgg

SEQ ID NO: 7092 - DNA, 71 bp, Homo sapiens
gaatgatacggaatacaatggaatggaacgaaatgaaatggaatggaatggaatggaatggaatggaatgg

SEQ ID NO: 7093 - DNA, 104 bp, Homo sapiens
acagcaagagagaaataaaacgacaagaaaactacaaaatgcctatcaatagttactttaaatatcagtggaccaaatcagtgaaacaaaagacacagagtggc

SEQ ID NO: 7094 - DNA, 89 bp, Homo sapiens
aatggactcgaatggattaatcattgaacggaatcgaatggaatcatcatcggatggtaatgaatggaatcatcatcgaatggaatcgg

SEQ ID NO: 7095 - DNA, 101 bp, Homo sapiens
gaatggaatcgaaaggaatgtcatcgaatggaatggaatggaacggaatggaatcgaatggaatggactcgaatggaatagaatcgaatgcaatggcatcg

SEQ ID NO: 7096 - DNA, 74 bp, Homo sapiens
atcgaatggaatcaacatcagacggaaaaaaacggaattatcaaatggaatcgaagagaatcatcgaatggacc

SEQ ID NO: 7097 - DNA, 88 bp, Homo sapiens
agcaacttcagcaaagtctcaggatacaaaatcaatgtgcaaaaatcaaaagcattcttatgcaccaataacagacacagagccaaat

SEQ ID NO: 7098 - DNA, 79 bp, Homo sapiens
aatggaatggaacgcaattgaatggaatggaatggaacggaatcaacctgagtcaaatggaatggaatggaatggaatg

SEQ ID NO: 7099 - DNA, 82 bp, Homo sapiens
ggaacgaaatcgaatggaacggaatagaatagactcgaatgtcatggattgctatgtaattgattggaatggaatggaatcg

SEQ ID NO: 7100 - DNA, 80 bp, Homo sapiens
tagcaggaaacagcaaactcaaattaagtaatttcaagagcgtatcatcaatgaactattttcaaagatgtgggcaagat

SEQ ID NO: 7101 - DNA, 96 bp, Homo sapiens
gaattgaaaggaatgtattggaataaaatggaatcgaataggttgaaataccataggttcgaattgaatggaatgggagggacaccaatggaattg

SEQ ID NO: 7102 - DNA, 89 bp, Homo sapiens
aagcaacttcagcaaagtctcgggatacaaaatcaatgtgcaaaaatcacaagcattcttatacaccactaacagacaaatggagagtc

SEQ ID NO: 7103 - DNA, 113 bp, Homo sapiens
gaatggaatcaacatcaaacggaaaaaaacggaattatcgaatggaatcgaagagaatcatcgaatggaccagaatggaatcatctaatggaatggaatggaataatccatgg

SEQ ID NO: 7104 - DNA, 77 bp, Homo sapiens
aaaagcaattggactgattttaaatatacgtggcaacaaggataaactgctaatgatgggtttgcaaatacagatcg

SEQ ID NO: 7105 - DNA, 70 bp, Homo sapiens
aatggaatcaacatcgaacggaaaaaaacggaattatcgaatggaatcgaagagaatcatcgaatggacc

SEQ ID NO: 7106 - DNA, 78 bp, Homo sapiens
aaacggaattatcaaatggaatcgaagagaatcatcgaacggactcgaatggaatcatctaatggaatggaatggaag

SEQ ID NO: 7107 - DNA, 108 bp, Homo sapiens
tgcaagataacacattttagttgacaccattgaaaacagttttaaccaagaatattagaaccaatgaagcagagaaatcaaaagggtggatggaactgccaaaggatg

SEQ ID NO: 7108 - DNA, 97 bp, Homo sapiens
tagaacagaattgaatggaatggcatcaaatggaatggaaacgaaaggaatggaattgaatggactcaaatgttatggaatcaaagggaatggactc

SEQ ID NO: 7109 - DNA, 93 bp, Homo sapiens
aagagaatcatcgaatggaatcgaatggaatcaacatcaaacggaaaaaaacggaattatcgaatggaatcgaagagaatcatcgaatggacc

SEQ ID NO: 7110 - DNA, 64 bp, Homo sapiens
atcaacatcaaacggaaaaaaacggaattatcgaatggaatcgaagagaatcatcgaatggacc

SEQ ID NO: 7111 - DNA, 66 bp, Homo sapiens
gaatcaacatcaaacggaaaaaaaccgaattatcgaatggaatcgaagagaatcatcgaatggacc

SEQ ID NO: 7112 - DNA, 106 bp, Homo sapiens
atcaacatcaaacggaatcaaacggaattatcgaatggaatcgaagagaatcatcaaatggactcgaatggaatcatctaatggaatggaatggaagaatccatgg

SEQ ID NO: 7113 - DNA, 89 bp, Homo sapiens
atcgaatggaatcattgaatggaaaggaatggaatcatcatggaatggaaacgaatggaatcactgaatggactcgaatgggatcatca

SEQ ID NO: 7114 - DNA, 90 bp, Homo sapiens
attcagcctttaaaaaaagaagacagtcctgtcatttgtgacaatatgaatgaaacagacatcacattaaatgaaatgagccaggcgcag

SEQ ID NO: 7115 - DNA, 136 bp, Homo sapiens
gaatgaaatgaaatcaaatggaatgtacatgaatggaatagaaaagaatgcatctttctcgaacggaagtgcattgaatggaaaggaatctactggaatggattcgaatggaatggaatgggatggaatggtatgg

SEQ ID NO: 7116 - DNA, 157 bp, Homo sapiens
aacatcaaacggaatcaaacggaattatcgaatggaatcgaagagaatcatcgaacggactcgaatggaatcatctaatggaatggaatggaagaatccatggactcgaatgcaatcatcatcgaatgaaatcgaatggaatcatcgaatggactcg

SEQ ID NO: 7117 - DNA, 72 bp, Homo sapiens
atggaattcaatggaatggacatgaatggaatggacttcaatggaatggtatcaaatggaatggaattcagt

SEQ ID NO: 7118 - DNA, 85 bp, Homo sapiens
aatggaaaggaatcgaatggaagggaatgaaattgaatcaacaggaatggaagggaatagaatagacggcaatggaatggactcg

SEQ ID NO: 7119 - DNA, 88 bp, Homo sapiens
agcaacttcagcaaagtatcaggatacaaaatcaatgtacaaaaatcccaagcattcttatacaccaacaacagacaaacagagagcc

SEQ ID NO: 7120 - DNA, 88 bp, Homo sapiens
agcaacttcagcaaagtctcaggatacaaaatcgatgtgcaaaaatcacaagcattcttatacaccaacaacagataaacagagagcc

SEQ ID NO: 7121 - DNA, 106 bp, Homo sapiens
aacggaaaaaaaacggaattatcgaatggaatcgaagagaatcatcgaatggaccagaatggaatcatctaatggaatggaatggaataatccatggactcgaatg

SEQ ID NO: 7122 - DNA, 102 bp, Homo sapiens
ggaatcaaacggaattatcgaatggaatcgaagagaatcatagaacggactcaaatggaatcatctaatggaatggaatgggagaatccatggactcgaatg

SEQ ID NO: 7123 - DNA, 70 bp, Homo sapiens
aatggaatcaatatcaaacggaaaaaaacggaattatcgaatggaatcgaagagaatcatcgaatggacc

SEQ ID NO: 7124 - DNA, 96 bp, Homo sapiens
aacggaatcaaacggaattatcgaatggaatcgaaaagaatcatcgaacggactcgaatggaatcatctaatggaatggaatggaagaatccatgg

SEQ ID NO: 7125 - DNA, 90 bp, Homo sapiens
aaacggaattatcgaatggaatcaaagagaatcatcgaatggccacgaatggaatcatataatggaatggaatggaataatccatggacc

SEQ ID NO: 7126 - DNA, 85 bp, Homo sapiens
aatggaatcgaatggattgatatcaaatggaatggaatggaagggaatggaatggaatggaattgaaccaaatgtaatggatttg

SEQ ID NO: 7127 - DNA, 89 bp, Homo sapiens
taaaagacggaacagatagaaagcagaaaggaaaggtgaattgcattaccactattcatactgccacacacatgacattaggccaagtc

SEQ ID NO: 7128 - DNA, 79 bp, Homo sapiens
aatggaatcgaatggaacaatcaaatggactccaatggagtcatctaatggaatcgagtggaatcatcgaatggactcg

SEQ ID NO: 7129 - DNA, 102 bp, Homo sapiens
taacacataaacaaacacagagacaaaatctccgagatgttaatctgctccagcaatacagaacaatttctattaccaacagaatgcttaatttttctgcct

SEQ ID NO: 7130 - DNA, 77 bp, Homo sapiens
ggaatcgaatggaatcaacatcaaacggaaaaaaacggaattatcgaatggaatcaaagagaatcatcgaatggacc

SEQ ID NO: 7131 - DNA, 51 bp, Homo sapiens
agaatggaaaggaatcgaaacgaaaggaatggagacagatggaatggaatg

SEQ ID NO: 7132 - DNA, 89 bp, Homo sapiens
gaatcatcataaaatggaatcgaatggaatcaacatcaaatggaatcaaatggtctcgaatggaatcatcttcaaatggaatggaatgg

SEQ ID NO: 7133 - DNA, 127 bp, Homo sapiens
aacaacaatgacaaacaaacaacaacgacaaagacatttatttggttcacaaatctccagggtgtacaagaagcatggtgccagcatctgctcagcttctgatgagggctctgggaagcttttactc

SEQ ID NO: 7134 - DNA, 96 bp, Homo sapiens
aacggactcgaacggaatataatggaatggaatggattcgaaaggaatggaatggaatggacaggaaaagaattgaatgggattggaatggaatcg

SEQ ID NO: 7135 - DNA, 112 bp, Homo sapiens
aacatcaaacgaaatcaaacggaattatcaaattgaatcgaagagaatcatcgaattgccacgaatgcaatcatctaatggtatggaatggaataatccatggacccagatg

SEQ ID NO: 7136 - DNA, 94 bp, Homo sapiens
agaaattaacagcaaaagaaggatgcagtgcaactcaggacaacacatacaattcaagcaacaaatgtatagtggctgggcaccaaggatacag

SEQ ID NO: 7137 - DNA, 82 bp, Homo sapiens
gcaataaaatcgactcagatagagaagaatgcaatggaatggaatggaatggaatggaatgggatggaatggtatggaatgg

SEQ ID NO: 7138 - DNA, 97 bp, Homo sapiens
aatggactcgaatgaaatcatcatcaaacggaatcgaatggaatcattgaatggaaaggatgggatcatcatggaatggaaacgaatggaatcactg

SEQ ID NO: 7139 - DNA, 82 bp, Homo sapiens
ccacataaaacaaaactacaagacaatgataaagttcacaacattaacacaatcagtaatggaaaagcctagtcaatggcag

SEQ ID NO: 7140 - DNA, 157 bp, Homo sapiens
tggaatggaatggaatggaatcaaatcgcatggtaatgaatcaaatggaatcaaatcgaatggaaataatggaatcgaagggaaacgaatggaatcgaattgcactgattctactgacttcgaggaaaatgaaatgaaatgcggtgaagtggaatgg

SEQ ID NO: 7141 - DNA, 71 bp, Homo sapiens
gaatgttatgaaatcaactcgaacggaatgcaatagaatggaatggaatggaatggaatggaatggaatgg

SEQ ID NO: 7142 - DNA, 104 bp, Homo sapiens
aatggaatcattgaatggaatggaatggaatcatcaaagaaaggaatcgaagggaatcatcgaatggaatcaaacggaatcatcgaatggaatggaatggaatg

SEQ ID NO: 7143 - DNA, 68 bp, Homo sapiens
ggaatcaacatcaaacggaaaaaaaacggaattatcgaatggaatcgaagagaatcatcgaatggacc

SEQ ID NO: 7144 - DNA, 69 bp, Homo sapiens
ggaataatcatcatcaaacagaaccaaatggaatcattgaatggaatcaaaggcaatcatggtcgaatg

SEQ ID NO: 7145 - DNA, 108 bp, Homo sapiens
gcatagaatcgaatggaattatcattgaatggaatcgaatggaatcaacatcaaacggaaaaaaacggaattatcgaatggaatcgaagagaatcatcgaatggaccc

SEQ ID NO: 7146 - DNA, 82 bp, Homo sapiens
aatggaatcgaagagaatcatcgaacggactcgaatggaatcatctaatggaatggaatggaataatccatggacccgaatg

SEQ ID NO: 7147 - DNA, 99 bp, Homo sapiens
aaatgaatcgaatggaattgaatggaatcaaatagaacaaatggaatcgaaatgaatcaaatggaatcgaatcgaatggaattgaatggcatggaattg

SEQ ID NO: 7148 - DNA, 79 bp, Homo sapiens
agttaatccgaatagaatggaatggaatgcaatggaacggaatggaacggaatggaatggaatggaatggaatggaatg

SEQ ID NO: 7149 - DNA, 131 bp, Homo sapiens
atcacaatcacacaacacattgcacatgcataacatgcactcacaatacacacacaacacatacacaacacacatgcaatacaacacaaaacgcaacacaacatatacacaacacacagcacacacatgcc

SEQ ID NO: 7150 - DNA, 87 bp, Homo sapiens
aaagacttaaacgttagacctaaaaccataaaaaccctagaggaaaacctaggcattaccattcaggacttaggcatgggcaaggac

SEQ ID NO: 7151 - DNA, 108 bp, Homo sapiens
aaagtccaaagatgaacaaaatatccagaaggaaaacaaatgcacttggggagtgggaaagaaaaccaagactgagcaatgcgtcaagctcagacgtgcctcactacg

SEQ ID NO: 7152 - DNA, 97 bp, Homo sapiens
aaacggaatcaaacggaattatcgaatggagtcgaaaagaatcatcgaacggactcgaatggaatcatctaatggaatggaatggaagaatccatgg

SEQ ID NO: 7153 - DNA, 94 bp, Homo sapiens
aattgattcgaaattaatggaattgaatggaatgcaatcaaatggaatggaatgtaatgcaatggaatgtaatagaatggaaagcaatggaatg

SEQ ID NO: 7154 - DNA, 79 bp, Homo sapiens
tacagaacacatgactcaacaacagcagaaagcatattcttttcaaatgcacatgaaacattatcatgatggaccaaat

SEQ ID NO: 7155 - DNA, 65 bp, Homo sapiens
ggaacaaaatgaaatcgaacggtaggaatcatacagaacagaaagaaatggaacggaatggaatg

SEQ ID NO: 7156 - DNA, 68 bp, Homo sapiens
aacggaaaaaacggaattatcgaatggaatcgaagagaatcatcgaatggaatcgaatggagtcatcg

SEQ ID NO: 7157 - DNA, 75 bp, Homo sapiens
aatcgaacggaatcaacatcaaacggaaaaaaacggaattatcgaatggaatcgaagagaatcatcgaatggacc

SEQ ID NO: 7158 - DNA, 87 bp, Homo sapiens
agaatggaatgcaatagaatggaatgcaatggaatggagtcatccgtaatggaatggaaaggaatgcaatggaatggaatggaatgg

SEQ ID NO: 7159 - DNA, 165 bp, Homo sapiens
atggaatcaacatcaaacggaatcaaacggaattatcgaatggaatcgaagagaatcatcgaacggattcgaatggaatcatctaatggaatggaatggaagaatccatggactcgaatgcaatcatcagcgaatggaatcgaatggaatcatcgaatggactcg

SEQ ID NO: 7160 - DNA, 98 bp, Homo sapiens
ggaataaaacggactcaatagtaatggattgcaatgtaattgattcgatttcgaatggaatcgcatggaatgtaatggaatggaatggaatggaaggc

SEQ ID NO: 7161 - DNA, 70 bp, Homo sapiens
aatggaatcaacatcaaacggaaaaaaacggaattatcgtatggaatcgaaaagaattatcgaatggacc

SEQ ID NO: 7162 - DNA, 57 bp, Homo sapiens
tcaaacggaaaaaaacggaattatcgaatggaatcgaagagaatcatcgaatggacc

SEQ ID NO: 7163 - DNA, 111 bp, Homo sapiens
acatcaaacggaatcaaacggaattatcgaatggaatcgaaaagaatcatcgaacggactcgaatggaatcatctaatggaatggaatggaagaatccatggactcgaatg

SEQ ID NO: 7164 - DNA, 78 bp, Homo sapiens
tggaatcgaatggaatcaacatcaaacggaaaaaaacggaattatcgaatggaatcgaagagaatcatcgaatggacc

SEQ ID NO: 7165 - DNA, 76 bp, Homo sapiens
aatggaatcgaatgcaatcatcgaacggaatcgaatggcatcaccgaatggaatggaatggaatggaatggaatgg

SEQ ID NO: 7166 - DNA, 87 bp, Homo sapiens
agaattgattgaatccaagtggaattgaatggaatggaatggattagaaaggaatggaatggattggaatggattggaatggaaagg

SEQ ID NO: 7167 - DNA, 96 bp, Homo sapiens
aactgcatcaactaacaggcaaaataaccagctaatatcataatgacaggattaaattcacaaatgacaatattaaccgtaaatgtaaatgggcta

SEQ ID NO: 7168 - DNA, 108 bp, Homo sapiens
gtaaacaaacaatcaagcaagtaagaacagaaataacagcatttggcttttgagttaatgacaagaacactcggcatgggagcctgggtgagcaaatcacagatcttc

SEQ ID NO: 7169 - DNA, 84 bp, Homo sapiens
aaaggaatggactggaacaaaatgaaatcgaacggtaggaatcgtacagaacggacagaaatggaacggcatggaatgcactcg

SEQ ID NO: 7170 - DNA, 91 bp, Homo sapiens
gaatcaacccgagcggaaaggaatggaatggaatggaatcaacacgaatggaatggaacggaatggaatgggatgggatgaaatggaatgg

SEQ ID NO: 7171 - DNA, 71 bp, Homo sapiens
aagaaatggaatcgaagagaatggaaacaaacggaatggaattgaatggaatggaattgaatggaatggga

SEQ ID NO: 7172 - DNA, 101 bp, Homo sapiens
gacatgcaaacacaacacacagcacacatggaacatgcatcagacatgcaaacacaacacacataccacacatggcatatgcatcagacgtgcctcactac

SEQ ID NO: 7173 - DNA, 135 bp, Homo sapiens
aaaggaatgcactcgaatggaatggacttgaatggaatgtctccgaatggaacagactcgtatgaaatggaatcgaatggaatggaatcaaatggaattgatttgagtgaaatggaatcaaatggaatggcaacg

SEQ ID NO: 7174 - DNA, 89 bp, Homo sapiens
ggaacaaaatgaaatcgaacggtaggaatcgtacagaacggaaagaaatggaacggaatggaatgcactcgaatggaaaggagtccaat

SEQ ID NO: 7175 - DNA, 95 bp, Homo sapiens
aaattgattgaaatcatcataaaatggaatcgaagggaatcaacatcaaatggaatcaaatggaatcattgaacggaattgaatggaatcgtcat

SEQ ID NO: 7176 - DNA, 84 bp, Homo sapiens
agaatggaaagcaatagaatggaacgcactggattcgagtgcaatggaatcaattggaatggaatcgaatggaatggattggca

SEQ ID NO: 7177 - DNA, 103 bp, Homo sapiens
aacaccaaacggaaaaaaacggaattatcgaatggaatcgaagagaatcttcgaacggacccgaatgggatcatctaatggaatggaatggaataatccatgg

SEQ ID NO: 7178 - DNA, 94 bp, Homo sapiens
aatggagactaatgtaatagaatcaaatggaatggcatcgaatggaatggactggaatggaatgtgcatgaatggaatggaatcgaatggattg

SEQ ID NO: 7179 - DNA, 151 bp, Homo sapiens
aaatcgaatggaacgcaatagaatagactcgaatgtaatggattgctatgtaattgattcgaatggaatggaatcgactggaatgcaatccaatggaatggaatgcaatgcaatggaatggaatcgaacggaatgcagtggaagggaatgg

SEQ ID NO: 7180 - DNA, 107 bp, Homo sapiens
aatcaacaaggaactgaaacaagtaaacaagaaaacaaataacaccataaaacatgggcaaaggacataaacagacatttttcaaaaaagacatacaaatggccgag

SEQ ID NO: 7181 - DNA, 89 bp, Homo sapiens
aatggaatcaacatcaaacggaaaaaaacggaattatcgaatggaatcgaagagaatcatcgaatggacccaggctggtcttgaactcc

SEQ ID NO: 7182 - DNA, 82 bp, Homo sapiens
attgaatgggctagaatggaatcatctttgaacggaatcaaagggaatcatcatcgaatggaatcgaatggaaatgtcaacg

SEQ ID NO: 7183 - DNA, 143 bp, Homo sapiens
aatggactcgaatggaatcaacatcaaatggaatcaagcggaattatcgaatgaaatcgaagagaatcatcgaatggactcgaaaggaatcatctaatggaatggaatggaataatccatggactcgaatgcaatcatcatcg

SEQ ID NO: 7184 - DNA, 97 bp, Homo sapiens
aaacggaaaaaaacggaattattgaatggaatcgaagagaatcttcgaacggacccgaatggaatcatctaatggaatggaatggaataatccatgg

SEQ ID NO: 7185 - DNA, 79 bp, Homo sapiens
actcgagtggaattgactgtaacaaaatggaaagtaacggattggaatcgaatggaacggaatggaatggaatggacat

SEQ ID NO: 7186 - DNA, 120 bp, Homo sapiens
tacaaactttaaaaaatgatcaacagatacacagttagcaagaaagaattgagggcaaagaatatgccagacaaactcaagaggaagatgatggtagagataggtcacattggagtgtca

SEQ ID NO: 7187 - DNA, 66 bp, Homo sapiens
aaatcaacaacaaacggaaaaaaaaggaattatcgaatggaatcaaagagaatcatcgaatggacc

SEQ ID NO: 7188 - DNA, 105 bp, Homo sapiens
aacggaatcaaacggaattatcgaatggaatcgaaaagaatcatcgaacggactcgaatggaatcatctaatgtaatggaatggaagaatccatggactcgaatg

SEQ ID NO: 7189 - DNA, 105 bp, Homo sapiens
aacggaaaaaaacggaattatcgaatggaatcgaagagaatcatcgaatggaccagaatggaatcatctaatggaatggaatggaataatccatggactcgaatg

SEQ ID NO: 7190 - DNA, 103 bp, Homo sapiens
caacatcaaacggaaaaaaacggaattatggaatggaatcgaagagaatcatcgaatggacccgaatggaatcatctgaaatataatagactcgaaaggaatg

SEQ ID NO: 7191 - DNA, 78 bp, Homo sapiens
atggaatcgaatggaatggactggaatggaatggattcgaatggaatcgaatggaacaatatggaatggtaccaaatg

SEQ ID NO: 7192 - DNA, 71 bp, Homo sapiens
gaatggaatcaacatcaaacggaaaaaaacggaattatcgaatggaatcgaagagaatcatcgaatggacc

SEQ ID NO: 7193 - DNA, 89 bp, Homo sapiens
aaatggactcgaatggaatcatcatagaatggaatcgaatgcaatggaatggaatcttccggaatggaatggaatggaatggaatggag

SEQ ID NO: 7194 - DNA, 85 bp, Homo sapiens
gaatcatcataaaatggaatcgaatggaatcaacatcaaatggaatcaaatggaatcattgaacggaattgaatggaatcgtcat

SEQ ID NO: 7195 - DNA, 74 bp, Homo sapiens
atcgaatggaatcaacatcaaacggaaaaaaacggaattatcgaatggaatcgaagagaatcatcgaatggacc

SEQ ID NO: 7196 - DNA, 92 bp, Homo sapiens
agcaacttcagcaaagtctcaggatacaaaatcaatgtacaaaaatcacaagcattcttatacaccaataacagacaaacagagagccaaaa

SEQ ID NO: 7197 - DNA, 89 bp, Homo sapiens
agaaacagaaaacagtcaaaccaatgggcaatccatatcagatgcagtattatgaacagaagtgtaaagaatgcaccaggcacaatggc

SEQ ID NO: 7198 - DNA, 131 bp, Homo sapiens
gattggaacgaaatcgaatggaacggaatagaatagactcgaatgtaatggattgctatgtaattgattcgaatggaatggaatcgaatggaatgcaatccaatggaatggaatgcaatgcaatggaatgg

SEQ ID NO: 7199 - DNA, 126 bp, Homo sapiens
atggaatggaataatcaacgtactcgaatgcaatcatcatcgtatagaatcgaatggaatcatcgaatggactcgaatggaataatcattgaacggagtcgaatggaatcatcatcggatggaaac

SEQ ID NO: 7200 - DNA, 95 bp, Homo sapiens
aaagaaatcgaatggaatcagtgtcgaatggaatggaatggaatcgaagaattgaattgagtagaatcgaagggaatcattggatgggctcaaat

SEQ ID NO: 7201 - DNA, 77 bp, Homo sapiens
agaaaagataactcgattaacaaatgaacaaacacctgaatacacaagtctcaaaagaagacataaaaatggccaac

SEQ ID NO: 7202 - DNA, 102 bp, Homo sapiens
atggaatcaacatcaaacggaatcacacggaattatcgaatggaatcgaaaagaatcatcgaacggactcgaatggaatcatctaatggaatggaatggaag

SEQ ID NO: 7203 - DNA, 103 bp, Homo sapiens
aatggaatcaacatcaaacggaatcaagcgaaattatcgaatggaatcgaagagaatcatcgaatggactcgaatggaatcatctaatggaatggaatgggat

SEQ ID NO: 7204 - DNA, 82 bp, Homo sapiens
aaacacagtacaaatactaattcaaatcaaacttactcaaagtcataatcaaacatgccagacgggctgaggggcagcatta

SEQ ID NO: 7205 - DNA, 100 bp, Homo sapiens
ggaatcgagtggaatcatcgaaagaaatcgaatggaatcattgtcgaatggaatggaatggaatcaaagaatggaatcgaagggaatcattggatgggct

SEQ ID NO: 7206 - DNA, 139 bp, Homo sapiens
aaagaaagacagagaacaaacgtaattcaagatgactgtttacatatccaagaacattagatggtcaaagactttaagaaggaatacattcaaaggcaaaaagtcacttactgattttggtggagtttgccacatggac

SEQ ID NO: 7207 - DNA, 148 bp, Homo sapiens
gaaaggaatcatcattgaatgcaatcacatggaatcatcacagaatggaatcgtacggaatcatcatcgaatggaattgaatggaatcatcaattggactcgaatggaatcatcaaatggaatcgattggaagtgtcaaatggactcg

SEQ ID NO: 7208 - DNA, 57 bp, Homo sapiens
caatcagagcggacacaaacaaattgcatgggaagaatcaatatcgtgaaaatggcc

SEQ ID NO: 7209 - DNA, 72 bp, Homo sapiens
cagcgcaccacagcacacacagtatacacatgacccacaatacacacaacacacaacacattcacacaccac

SEQ ID NO: 7210 - DNA, 87 bp, Homo sapiens
gcaaacagaattcaacactacattagaacgatcattcatcacgacctagtaggatgtttttcctgggatgcaaggatggttcaacat

SEQ ID NO: 7211 - DNA, 71 bp, Homo sapiens
caatcaaaacagcaatgagataccattttacaccaatcaaaatggctactaaaaagtcaaaagcaaatgcc

SEQ ID NO: 7212 - DNA, 93 bp, Homo sapiens
tggaatagaatggaatcaatgttaagtggaatcgagtggaatcatcgaaagaaatcgaatggaatcattgtcgaatggtatggaatggaatca

SEQ ID NO: 7213 - DNA, 124 bp, Homo sapiens
aatggaatggaatcatcgcatagaatggaatggaattatcatcgaattgaatcgaatggtatcaacatcaaacggaaaaaaacggaaatatcgaatggaatcgaagagaatcatcgaacggacc

SEQ ID NO: 7214 - DNA, 90 bp, Homo sapiens
gaaaaacaaaacaaaacaaacaaacaaacaatcaaaaaagtggtagcagaaaccagaaagtccatgtatatagctaattggcctggttgt

SEQ ID NO: 7215 - DNA, 80 bp, Homo sapiens
agacctttctcagaagacacacaaattgccaacaggtatatgaaaaaatgttcaatatcactaatcatcagggcgatgcc

SEQ ID NO: 7216 - DNA, 106 bp, Homo sapiens
catggaatcgaatggaattatcatcgaatggaatcgaatggtaccaacaccaaacggaaaaaaacggaattatcgaatggaatcgaagagaatcttcgaacggacc

SEQ ID NO: 7217 - DNA, 87 bp, Homo sapiens
agagcagaaacaaatggaattgaaatgaagacaacaatcaaaagcatcaatgaaatgaaaagttgggttttggaagagagaaacaat

SEQ ID NO: 7218 - DNA, 70 bp, Homo sapiens
acacaaacacacacacacacacacacacacacacacacacacacacacacacacacacacacacacatac

SEQ ID NO: 7219 - DNA, 107 bp, Homo sapiens
aacaaacaaatgagatgatttcagatagtgataaacactataacataattaattcgtgccaatcagagcataacagtggtgtggtggctgtggaacagatagcagac

SEQ ID NO: 7220 - DNA, 79 bp, Homo sapiens
aatggaatcgagtggaatggaaggcaatggaatagaatggaatggaatcgaaaggaacggaatggaatggaatggaatg

SEQ ID NO: 7221 - DNA, 73 bp, Homo sapiens
agaaatggaatcggagagaatggaaacaaatggaatggaattgaatggaatggaattgaatggaatgggaacg

SEQ ID NO: 7222 - DNA, 87 bp, Homo sapiens
aagagaactgcaaaacactgctcaaagaaatcagagatgacaaaaacacatggaaaaacgtttcatgctcatggattggaagactta

SEQ ID NO: 7223 - DNA, 83 bp, Homo sapiens
aatcaacacgaatagaatggaacggaatggaatggaatggaatggaatggaatggagtggaatggaacagaatggagtggaat

SEQ ID NO: 7224 - DNA, 112 bp, Homo sapiens
aacatcaaacgaaatcaaacggaattatcaaattgaatcgaagagaatcatcgaattgccacgaatgcaaccatctaatggtatggaatggaataatccatggacccagatg

SEQ ID NO: 7225 - DNA, 94 bp, Homo sapiens
cggaattatcatcgaatgtaatcgaatggaatcaacatcaaacggaaaaaaacggaattatcgaatggaatcgaagagaatcatcgaatggacc

SEQ ID NO: 7226 - DNA, 125 bp, Homo sapiens
tggacacacacgaacacacacctacacacacgtggacacacacggacacatggacacacacgaacacatggacacacacacggggacacacacagacacacacagagacacacacggacacatgg

SEQ ID NO: 7227 - DNA, 100 bp, Homo sapiens
atcaaacggaatcaaacggaattatcgaatggaatcgaagagaatcatcgaatggactcgaatggaatcatctaatggaatggaatggaagaatccatgg

SEQ ID NO: 7228 - DNA, 99 bp, Homo sapiens
aaatggaatggaatgcacttgaaaggaatagactggaacaaaatgaaatcgaacggtaggaatcatacagaacagaaagaaatggaacggaatggaatg

SEQ ID NO: 7229 - DNA, 68 bp, Homo sapiens
accacacacaaaatacaccacacaccacacacacaccacacactatacacacaccacacaccacacac

SEQ ID NO: 7230 - DNA, 100 bp, Homo sapiens
aaagaaatagaagggagttgaacagaatcgaatggaatcgaatcaaatggaatcgaatggcatcaaatggaatcgaatggaatgtggtgaagtggattgg

SEQ ID NO: 7231 - DNA, 86 bp, Homo sapiens
ggaatcatcataaaatggaatcgaatggaatcatcatcaaatggaatcaaatggaatcattgaacggaattgaatggaatcgtcat

SEQ ID NO: 7232 - DNA, 80 bp, Homo sapiens
aaagatcaatgtacaaaaatcagcagcatttctataaaccaacaatgtccaggctgagagagaaatcaagaaaacaattc

SEQ ID NO: 7233 - DNA, 77 bp, Homo sapiens
tggaatggaatggaatgaaataaacacgaatagaatggaacggaatggaacggaatggaatggaatggaatggaaag

SEQ ID NO: 7234 - DNA, 92 bp, Homo sapiens
taatcagcacaatcaactgtagtcacaaaacaaatagtaacgcaatgataaagaaacagagaactagttcaaataaacatgataagatgggg

SEQ ID NO: 7235 - DNA, 78 bp, Homo sapiens
aagcggaattatcaaatggaatcgaagagaatggaaacaaatggaatggaattgaatggaatggaattgaatggaatg

SEQ ID NO: 7236 - DNA, 70 bp, Homo sapiens
aatggaatcaacatcaaacggaaaaaaacggaattatcgaatggaatcgaagagaatcatcgaatggacc

SEQ ID NO: 7237 - DNA, 92 bp, Homo sapiens
acttgaatcgaatggaaaggaatttaatgaacttaaatcgaatggaatataatggtatggaatggactcatggaatggaatggaaaggaatc

SEQ ID NO: 7238 - DNA, 91 bp, Homo sapiens
tggaatcatcatcgaaagcaagcgaatggaatcatcaaatggaaacgaatggaatcatcgaatggactcggatggaattgttgaatggact

SEQ ID NO: 7239 - DNA, 68 bp, Homo sapiens
tggaatcaacatcaaacggaaaaaaacggaattatcgaatggaatcgaagagaatcatcgaatggacc

SEQ ID NO: 7240 - DNA, 86 bp, Homo sapiens
taagtgaattgaatagaatcaatctgaatgtaatgaaatggaatggaacggaatggaatggaatggaatggaatggaatggaatgg

SEQ ID NO: 7241 - DNA, 98 bp, Homo sapiens
aggaaaatttaatcagcaggaatagaaacacacttgagaaatccatgtggaatgaaaagagaatggctgagcagcaacagattgtcaaaaaggaaatc

SEQ ID NO: 7242 - DNA, 62 bp, Homo sapiens
aacatcaaacggaaaaaaaacggaattatcgaatggaatcgaagagaatcatcgaatggacc

SEQ ID NO: 7243 - DNA, 132 bp, Homo sapiens
taattgagaataagcattccagtggaaaaaaaactaaacaatttgttgtaaaacatccttaaaagcatcagaaagttaatacagcaatgaagaattacaggaccaaattaagaatggtatggaagcctgtta

SEQ ID NO: 7244 - DNA, 88 bp, Homo sapiens
tatcatcgaatggaatcgaatggaatcaacatcaaacggaaaaaaacggaattatcgaattgaatcgaagagaatcatcgaatggacc

SEQ ID NO: 7245 - DNA, 80 bp, Homo sapiens
agcaaaacaaacacaatctgtcgttcatggtactacgacatactgggagagatattcaaatgatcacacaaaacaacatg

SEQ ID NO: 7246 - DNA, 93 bp, Homo sapiens
aaggattcgaatggaatgaaaaagaattgaatggaatagaacagaatggaatcaaatcgaatgaaatggagtggaatagaaaggaatggaatg

SEQ ID NO: 7247 - DNA, 147 bp, Homo sapiens
aacggaatcaaacggaattatcgaatggaatcgaagagaatcatcgaacggactcgaatggaatcatctaatggaatggaatggaagaatccatggactcgaatgcaatcatcatcgaatggaatcgaacggaatcatcgaatggcc

SEQ ID NO: 7248 - DNA, 85 bp, Homo sapiens
aatcaactagatgtcaatggaatgcaatggaatagaatggaatggaattaacacgaatagaatggaatggaatggaatggaatgg

SEQ ID NO: 7249 - DNA, 88 bp, Homo sapiens
aatggactcgaatggaataatcattgaacggaatcgaatggaatcatcatcggatggaaatgaatggaatcatcatcgcatggaatcg

SEQ ID NO: 7250 - DNA, 76 bp, Homo sapiens
gaatggaatgatacggaatagaatggaatggaacgaaatggaattgaaaggaaaggaatggaatggaatggaatgg

SEQ ID NO: 7251 - DNA, 84 bp, Homo sapiens
aatcatcatcgaatggaatcgaatggtatcattgagtggaatcgaatggaatcatcatcagatggaaatgaatggaatcgtcat

SEQ ID NO: 7252 - DNA, 65 bp, Homo sapiens
gaatcaaatcaatggaatcaaatcaaatggaatggaatggaattgtatggaatggaatggcatgg

SEQ ID NO: 7253 - DNA, 125 bp, Homo sapiens
taatgcagtccaatagaatggaatcgaatggcatggaatataaagaaatggaatcgaagagaatgggaacaaatggaatggaattgagtggaatggaattgaatggaatgggaacgaatggagtg

SEQ ID NO: 7254 - DNA, 61 bp, Homo sapiens
aacatcaaacggaaaaaaacggaattatcgaatggaatcgaagagaatcatcgaatggacc

SEQ ID NO: 7255 - DNA, 99 bp, Homo sapiens
atcaaaaggaacggaatggaatggaatggaatggaatggaatggaatggaatggaatgaaatcaacccgaatggaatggattggcatagagtggaatgg

SEQ ID NO: 7256 - DNA, 80 bp, Homo sapiens
gccaacaatcatatgagaaaaagctcaacatcactgatcatttcaggaatgcaaatcaaaaccacaatgagatactatca

SEQ ID NO: 7257 - DNA, 99 bp, Homo sapiens
aatcaaatggaatgaaatcgaatggaattgaatcgaatggaatgcaatagaatgtcttcaaatggaatcgaatggaaattggtgaagtggacgggagtg

SEQ ID NO: 7258 - DNA, 71 bp, Homo sapiens
taatggaatcaacatcaaacggaaaaaaacggaattatcgaatgcaatcgaagagaatcatcgaatggacc

SEQ ID NO: 7259 - DNA, 88 bp, Homo sapiens
agcaacttcagcaaagtctcagcatacaaaatcaatgtgcaaaaatcacacgcattcctatacaccaataacagacaaacagagagcc

SEQ ID NO: 7260 - DNA, 70 bp, Homo sapiens
gaatcaaatggaatggactgtaatggaatggattcgaatggaatcgaatggagtggactcaaatggaatg

SEQ ID NO: 7261 - DNA, 93 bp, Homo sapiens
aacaagtggacgaaggatatgaacagacacttctcaagacatttatgcagccaacagacacacgaaaaaatgctcatcatcactggccatcag

SEQ ID NO: 7262 - DNA, 55 bp, Homo sapiens
aaacggaaaaaaacggaattatcgaatggaatcgaatagaatcatcgaatggacc

SEQ ID NO: 7263 - DNA, 105 bp, Homo sapiens
tggaaccgaacaaagtcatcaccgaatggaattgaaatgaatcataatcgaatggaatcaaatggcatcttcgaattgactcgaatgcaatcatccactgggctt

SEQ ID NO: 7264 - DNA, 84 bp, Homo sapiens
aacggaatcacgcggaattatcgaatggaatcgaagagaatcatcgaatggactcgaatggaatcatctaatggaatggaatgg

SEQ ID NO: 7265 - DNA, 96 bp, Homo sapiens
ggaatcaactcgattgcaatggaatgcaatggaaaggaatggaatgcaattaaagcgaatagaatggaatggaatggaatggaacggaatggaatg

SEQ ID NO: 7266 - DNA, 68 bp, Homo sapiens
aaaacaaacaacaacgacaaatcatgagaccagagttaagaaacaatgagaccaggctgggtgtggtg

SEQ ID NO: 7267 - DNA, 80 bp, Homo sapiens
aatcgaaaggaatgcaatattattgaacagaatcgaaaagaatggaatcaaatggaatggaacagagtggaatggactgc

SEQ ID NO: 7268 - DNA, 79 bp, Homo sapiens
aaggaatcgaatggaagtgaatgaaattgaatcaacaggaatggaagggaatagaatagactgtaatggaatggactcg

SEQ ID NO: 7269 - DNA, 65 bp, Homo sapiens
aacccgagtgcaatagaatggaatcgaatggaatggaatggaatggaatggaatggaatggagtc

SEQ ID NO: 7270 - DNA, 80 bp, Homo sapiens
gaatggaattgaaaggaatggaatgcaatggaatggaatgggatggaatggaatgcaatggaatcaactcgattgcaatg

SEQ ID NO: 7271 - DNA, 101 bp, Homo sapiens
gaaaaaaacggaattatcgaattgaatcaaatagaatcatcgaacggaccaaaatggaatcatctaatggaatggaatggaataatccatggactctaatg

SEQ ID NO: 7272 - DNA, 132 bp, Homo sapiens
tggaatcatctaatggaatggaatggaataatccatggactcgaatgcaatcatcataaaatggaatcgaatggaatcaacatcaaatggaatcaaatgggatcattgaacggaattgaatggaatcgtcat

SEQ ID NO: 7273 - DNA, 101 bp, Homo sapiens
gaaaaaaacggaattatcgaattgaatcgaatagaatcatcgaacggaccagaatggaatcatctaatggaatggaatggaataatccatggactcgaatg

SEQ ID NO: 7274 - DNA, 91 bp, Homo sapiens
aaccactgcttaaggaaataagagagaacacaaacaaatggaaaaacgttccatgctcatggataggagaatcaatatcgtgaaaatggcc

SEQ ID NO: 7275 - DNA, 95 bp, Homo sapiens
tatcgaatggaatggaaaggagtggagtagactcgaatagaatggactggaatgaaatagattcgaatggaatggaatggaatgaagtggactcg

SEQ ID NO: 7276 - DNA, 84 bp, Homo sapiens
gtatcaacatcaaacggaaaaaaacggaattatcgaatggaatcatctaatggaatggaatggaataatccatggactcgaatg

SEQ ID NO: 7277 - DNA, 87 bp, Homo sapiens
taaatggagacatcattgaatacaattgaatggaatcatcacatggaatcgaatggaatcatcgtaaatgcaatcaagtggaatcat

SEQ ID NO: 7278 - DNA, 83 bp, Homo sapiens
gaatggaattgaaaggtatcaacaccaaacggaaaaaaaaacggaattatcgaatggaatcgaagagaatcatcgaacggacc

SEQ ID NO: 7279 - DNA, 73 bp, Homo sapiens
agcaatttcagcaaagtctcaggatacaaaatcaatgtacaaattcacaagcattcttatggaccaacaacag

SEQ ID NO: 7280 - DNA, 68 bp, Homo sapiens
ggaatcgaatggcatcaacatcaaacggaaaaaaacggaattatcgaatggaatcgaatggaatcatc

SEQ ID NO: 7281 - DNA, 90 bp, Homo sapiens
aaacaaaacacagaaatgcaaagacaaaacataaaacgcagccataaaggacatattttagataactggggaaatttgtatgggctgtgt

SEQ ID NO: 7282 - DNA, 103 bp, Homo sapiens
aatggaatcaacatcaaacggaatcaaacggaattatcgaatggaatcgaagagaatcatcgaacggactcgaatggaatcatctaatggaatggaatggaag

SEQ ID NO: 7283 - DNA, 75 bp, Homo sapiens
aatcgaatggaatcagcatcaaacggaaaaaaacggaattatcgaatggaatcgaagagaatcatcgaatggacc

SEQ ID NO: 7284 - DNA, 94 bp, Homo sapiens
aaacggaattatagaatggactggaagagaatcatcgaacggactagaatggaatcatctaatcgaatggaatggaacaatccatggtctagca

SEQ ID NO: 7285 - DNA, 105 bp, Homo sapiens
tgaacagagaattggacaaaacgcacaaagtaaagaaaaagaatgaagcaacaaaagcagagatttattgaaaacaaaagtacacaccacacagggtgggagtgg

SEQ ID NO: 7286 - DNA, 99 bp, Homo sapiens
atcataacgacaagaacaaattcacacacaacaatattaacttcaaatccaaatgggttaaatgctccaattaaaggatgcagacgggcaaattggata

SEQ ID NO: 7287 - DNA, 99 bp, Homo sapiens
atcataacgacaagaacaaattcacacacaacaatattcacttcaaatccaaatgggttaaatgctccaattaaaggatgcagacgggcaaattggata

SEQ ID NO: 7288 - DNA, 94 bp, Homo sapiens
gaatggaatcgaatggattgatatcaactggaatggaatggaagggaatggaatggaatggaattgaaccaaatgtaatgacttgaatggaatg

SEQ ID NO: 7289 - DNA, 66 bp, Homo sapiens
gaatcaacatcaaacggaaaaaaacggaattatcgaatggaatcgaagagaatcatcgaatggacc

SEQ ID NO: 7290 - DNA, 67 bp, Homo sapiens
ggaatcaacatcaaacggaaaaaaacggaattatcgaatggaatcgaagagaatcatcgaatggacc

SEQ ID NO: 7291 - DNA, 135 bp, Homo sapiens
atggaatcaacatcaaacggaatcaaacggaattatcgaatggaatcaaagagaatcatcgaacggactcgaatggaatcatctaatggaatggaatggaagaatccatggactcgaatgcaatcatcatcgaat

SEQ ID NO: 7292 - DNA, 52 bp, Homo sapiens
ggaatggaatggaatggagccgaatggaatggaatgtactcaaatggaatgc

SEQ ID NO: 7293 - DNA, 150 bp, Homo sapiens
aaaacacctaggaatacagataacaagggacattaactacctcttaaagagaactacaaaccactgctcaaggaaatgagagaggacacaaacacatggaaaaacattccatcctcatggataggaagaatcaatattgtgaaaatggcc

SEQ ID NO: 7294 - DNA, 98 bp, Homo sapiens
aacacgactttgagaagagtaagtgattgttaattaaagcaagagaattattgatgtatcacagtcatgagaaatattggaaggaatatggtccatac

SEQ ID NO: 7295 - DNA, 66 bp, Homo sapiens
acacatatcaaacaaacaaaagcaattgactatctagaaatgtctgggaaatggcaagatattaca

SEQ ID NO: 7296 - DNA, 86 bp, Homo sapiens
ggaatcatcatataatggaatcgaatggaatcaacatcaaatggaatcaaatggaatcattgaacggaattgaatggaatcgtcat

SEQ ID NO: 7297 - DNA, 206 bp, Homo sapiens
aatggaatcaacatcaaacggaatcaaatggaattatcgaatggaatcgaagagaatcatcgaattgtcacgaatggaatcatctaatggaatggaatggaataatccatggcccctatgcaatggactcgaatgaaatcatcatcaaacagaatcgaatggaatcatctaatggaatggaatggcataatccatggactcgaatg

SEQ ID NO: 7298 - DNA, 91 bp, Homo sapiens
taaaatgaaacaaatatacaacacgaaggttatcaccagaaatatgccaaaacttaaatatgagaataagacagtctcaggggccacagag

SEQ ID NO: 7299 - DNA, 59 bp, Homo sapiens
aaaatacagcgttatgaaaagaatgaacacacacacacacacacacacacagaaaatgt

SEQ ID NO: 7300 - DNA, 138 bp, Homo sapiens
caaacaaataggtaccaaacaaataacaacataaacctgacaacacacttatttacaagagacatcccttatatgaaagggtacagaaaagtcgatggtaagatgatggggaaaggtataccaaccactagcagaagg

SEQ ID NO: 7301 - DNA, 93 bp, Homo sapiens
tggaatcgaatggaatcaatatcaaacggaaaaaaacggaattatcgaatggaatcgaaaagaatcatcgaatgggcccgaatggaatcatct

SEQ ID NO: 7302 - DNA, 85 bp, Homo sapiens
acaaatggaatcaacaacgaatggaatcgaatggaaacgccatcgaaaggaaacgaatggaattatcatgaaattgaaatggatg

SEQ ID NO: 7303 - DNA, 80 bp, Homo sapiens
aatcaataaatgtaaaccagcatataaacagaaccaacgacaaaaaccacatgattatctcaatagatgcagaaaaggcc

SEQ ID NO: 7304 - DNA, 94 bp, Homo sapiens
aaaataaacgcaaattaaaatcacaagataccaacacattcccacggctaagtacgaagaacaagggcgaatggtcagaattaagctcaaacct

SEQ ID NO: 7305 - DNA, 95 bp, Homo sapiens
caacatcaaacggaatcaaacggaattatcgaatggaatcgaagagaatcatcgaatggactcgaatggaatcatctaatggaatggaatggaag

SEQ ID NO: 7306 - DNA, 60 bp, Homo sapiens
acatcaaacggaaaaaaacggaattatcgaatggaatcgaagagaatcatcgaatggacc

SEQ ID NO: 7307 - DNA, 70 bp, Homo sapiens
aatggactcgaatagaattgactggaatggaatggactcgaatggaatggaatggaatggaagggactcg

SEQ ID NO: 7308 - DNA, 138 bp, Homo sapiens
aagaaagacagagaacaaacgtaattcaagatgactgattacatatccaagaacattagatggtcaaagactttaagaaggaatacattcaaaggcaaaacgtcacttactgattttggtggagtttgccacatggac

SEQ ID NO: 7309 - DNA, 83 bp, Homo sapiens
gaatggaatcgaatggaatgaacatcaaacggaaaaaaacggaattatcgaatggaatcaaagagaatcatcgaatggacccg

SEQ ID NO: 7310 - DNA, 96 bp, Homo sapiens
atggactcgaatgtaataatcattgaacggaatcgaatggaatcatcatcggatggaaacgaatggaatcatcatcgaatggaatcgaatgggatc

SEQ ID NO: 7311 - DNA, 66 bp, Homo sapiens
gaaatggaatggaaaggaataaaatcaagtgaaattggatggaatggattggaatggattggaatg

SEQ ID NO: 7312 - DNA, 98 bp, Homo sapiens
aaacggaaaaaaaacggaattatcgaatggaatcgaagagaatcatcgaacgaaccagaatggaatcatctaatggaatggaatggaataatccatgg

SEQ ID NO: 7313 - DNA, 78 bp, Homo sapiens
attaacccgaatagaatggaatggaatggaatggaacggaacggaatggaatggaatggaatggaatggaatggatcg

SEQ ID NO: 7314 - DNA, 61 bp, Homo sapiens
aacatcaaacggaaaaaaacggaattatcgtatggaatcgaagagaatcatcgaatggacc

SEQ ID NO: 7315 - DNA, 86 bp, Homo sapiens
gaatagaattgaatcatcattgaatggaatcgagtagaatcattgaaatcgaatggaatcatcatcgaatggaattgggtggaatc

SEQ ID NO: 7316 - DNA, 80 bp, Homo sapiens
caccgaatagaatcgaatggaacaatcatcgaatggactcaaatggaattatcctcaaatggaatcgaatggaattatcg

SEQ ID NO: 7317 - DNA, 68 bp, Homo sapiens
aatgcaatcgaatagaatcatcgaatagactcgaatggaatcatcgaatggaatggaatggaacagtc

SEQ ID NO: 7318 - DNA, 85 bp, Homo sapiens
aaatcatcatcgaatggaatcgaatggtatcattgaatggaatcgaatggaatcatcatcagatggaaatgaatggaatcgtcat

SEQ ID NO: 7319 - DNA, 95 bp, Homo sapiens
gaatggaatcgaaaggaatagaatggaatggatcgttatggaaagacatcgaatggaatggaattgactcgaatggaatggactggaatggaacg

SEQ ID NO: 7320 - RNA, 778 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 7321 - RNA, 761 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuuggucuuugaauaaagccugaguaggaag

SEQ ID NO: 7322 - RNA, 800 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 7323 - RNA, 785 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccacacuccguggucuuugaauaaagucugagugggcggc

SEQ ID NO: 7324 - RNA, 793 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguaccccccaaacaccauugucaguggucuuugaauaaagucugagugggcggc

SEQ ID NO: 7325 - RNA, 783 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucucaaacaccauugucacacuccauggucuuugaauaaagccugaguaggaag

SEQ ID NO: 7326 - RNA, 768 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucuacacuccuggucuuugaauaaagccugaguaggaag

SEQ ID NO: 7327 - RNA, 776 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcugccuucugcggggcuugccuucuggccaugcccuucuucucucccuugcaccuguaccucucaaacaccauugucauggucuuugaauaaagccugaguaggaag

SEQ ID NO: 7328 - RNA, 1549 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguacccccguggucuuugaauaaagucugagugggcggc

SEQ ID NO: 7329 - RNA, 1532 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucuuggucuuugaauaaagccugaguaggaag

SEQ ID NO: 7330 - RNA, 1571 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguaccccccaaacaccauugucacacuccaguggucuuugaauaaagucugagugggcggc

SEQ ID NO: 7331 - RNA, 1556 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguacccccacacuccguggucuuugaauaaagucugagugggcggc

SEQ ID NO: 7332 - RNA, 1564 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcuggagccucgguggccaugcuucuugccccuugggccuccccccagccccuccuccccuuccugcacccguaccccccaaacaccauugucaguggucuuugaauaaagucugagugggcggc

SEQ ID NO: 7333 - RNA, 1554 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucucaaacaccauugucacacuccauggucuuugaauaaagccugaguaggaag

SEQ ID NO: 7334 - RNA, 1539 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucuacacuccuggucuuugaauaaagccugaguaggaag

SEQ ID NO: 7335 - RNA, 1547 nt, Artificial Sequence
  Description of Artificial Sequence: Synthetic Transcript Sequence
gggaaauaagagagaaaagaagaguaagaagaaauauaagagccaccaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugauaauaggcugccuucugcggggcuugccuucuggccaugcccuucuucucucccuugcaccuguaccucucaaacaccauugucauggucuuugaauaaagccugaguaggaag

SEQ ID NO: 7336 - RNA, 1413 nt, Artificial Sequence
  Description of Artificial Sequence: Synthetic Transcript Sequence
gggaaauaagagagaaaagaagaguaagaagaaauauaagagccaccucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 7337 - RNA, 1407 nt, Artificial Sequence
  Description of Artificial Sequence: Synthetic Transcript Sequence
gggaaauaagagagaaaagaagaguaagaagaaauauaagaucgugaggaucuauuuccggugaauuccucgagacuaguucuagagcggccgcggaucccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucaccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 7338 - RNA, 772 nt, Artificial Sequence
  Description of Artificial Sequence: Synthetic Transcript Sequence
gggaaauaagagagaaaagaagaguaagaagaaauauaagaauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggcuggagccucgguggccaugcuucuugccccuugggccuccccccagccccuccuccccuuccugcacccguacccccguggucuuugaauaaagucugagugggcggc

SEQ ID NO: 7339 - RNA, 778 nt, Artificial Sequence; identical to SEQ ID NO: 7320
  Description of Artificial Sequence: Synthetic Transcript Sequence

SEQ ID NO: 7340 - DNA, 832 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataataggattcgtcagtagggttgtaaaggtttttcttttcctgagaaaacaaccttttgttttctcaggttttgctttttggcctttccctagctttaaaaaaaaaaaagcaaaagtggtctttgaataaagtctgagtgggcggctctaga

SEQ ID NO: 7341 - RNA, 809 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauaggauucgucaguaggguuguaaagguuuuucuuuuccugagaaaacaaccuuuuguuuucucagguuuugcuuuuuggccuuucccuagcuuuaaaaaaaaaaaagcaaaaguggucuuugaauaaagucugagugggcggc

SEQ ID NO: 7342 - DNA, 928 bp, Artificial Sequence
  Description of Artificial Sequence: Synthetic Transcript Sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataataggattcgtcagtagggttgtaaaggtttttcttttcctgagaaaacaaccttttgttttctcaggttttgctttttggcctttccctagctttaaaaaaaaaaaagcaaaagtggtctttgaataaagtctgagtgggcggctctaga

SEQ ID NO: 7343 - RNA, 905 nt, Artificial Sequence
  Description of Artificial Sequence: Synthetic Transcript Sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaauaggauucgucaguaggguuguaaagguuuuucuuuuccugagaaaacaaccuuuuguuuucucagguuuugcuuuuuggccuuucccuagcuuuaaaaaaaaaaaagcaaaaguggucuuugaauaaagucugagugggcggc

SEQ ID NO: 7344 - DNA, 834 bp, Artificial Sequence
  Description of Artificial Sequence: Synthetic Transcript Sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgataatagtgctcttcagtagggtcatgaaggtttttcttttcctgagaaaacaacacgtattgttttctcaggttttgctttttggcctttttctagcttaaaaaaaaaaaaagcaaaagtggtctttgaataaagtctgagtgggcggctctaga

SEQ ID NO: 7345 - RNA, 811 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaauagugcucuucaguagggucaugaagguuuuucuuuuccugagaaaacaacacguauuguuuucucagguuuugcuuuuuggccuuuuucuagcuuaaaaaaaaaaaaagcaaaaguggucuuugaauaaagucugagugggcggc

SEQ ID NO: 7346 - DNA, 930 bp, Artificial Sequence
  Description of Artificial Sequence: Synthetic Transcript Sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataatagtgctcttcagtagggtcatgaaggtttttcttttcctgagaaaacaacacgtattgttttctcaggttttgctttttggcctttttctagcttaaaaaaaaaaaaagcaaaagtggtctttgaataaagtctgagtgggcggctctaga

SEQ ID NO: 7347 - RNA, 907 nt, Artificial Sequence
  Description of Artificial Sequence: Synthetic Transcript Sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaauagugcucuucaguagggucaugaagguuuuucuuuuccugagaaaacaacacguauuguuuucucagguuuugcuuuuuggccuuuuucuagcuuaaaaaaaaaaaaagcaaaaguggucuuugaauaaagucugagugggcggc

SEQ ID NO: 7348 - DNA, 1638 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7349 - DNA, 1736 bp, Homo sapiens
gaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7350 - DNA, 1551 bp, Homo sapiens
atgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7351 - DNA, 1584 bp, Homo sapiens
atgcctggcttctactctgttatgacagatgaggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7352 - DNA, 1906 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7353 - DNA, 1650 bp, Homo sapiens
tacagctctccagccctgttcagcagcagagctgctccccagaagccaagaaaagaaggctcccaagcagctgggctgctggtcttctctgactctctggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 7354 - DNA, 1709 bp, Homo sapiens
gacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 7355 - protein, 459 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 7356 - protein, 478 aa, Homo sapiens
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 7357 - protein, 459 aa, Homo sapiens; identical to SEQ ID NO: 7355

SEQ ID NO: 7358 - protein, 470 aa, Homo sapiens
MPGFYSVMTDEEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 7359 - protein, 274 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 7360 - protein, 492 aa, Homo sapiens
YSSPALFSSRAAPQKPRKEGSQAAGLLVFSDSLEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 7361 - protein, 331 aa, Homo sapiens
MVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 7362 - RNA, 1600 nt, Artificial Sequence
  Description of Artificial Sequence: Synthetic Transcript Sequence
gggaaauaagagagaaaagaagaguaagaagaaauauaagagccaccauggaccguucacugggauggcaagggaauucugucccugaggacaggacugaagcugggaucaagcguuuccuggaggacaccacggaugauggagaacugagcaaguucgugaaggauuucucaggaaaugcgagcugccacccaccagaggcuaagaccugggcauccaggccccaagucccggagccaaggccccaggccccggaccucuaugaugaugaccuggaguucagaccccccucgcggccccaguccucugacaaccagcaguacuucugugccccagccccucucagcccaucugccaggccccgcagcccauggggcaagcuugaucccuaugauuccucugaggaugacaaggaguaugugggcuuugcaacccuccccaaccaaguccaccgaaaguccgugaagaaaggcuuugacuuuacccucaugguggcaggagagucuggccugggcaaauccacacuugucaauagccucuuccucacugaucuguaccgggaccggaaacuucuuggugcugaagagaggaucaugcaaacuguggagaucacuaagcaugcaguggacauagaagagaagggugugaggcugcggcucaccauuguggacacaccagguuuuggggaugcagucaacaacacagagugcuggaagccuguggcagaauacauugaucagcaguuugagcaguauuuccgagacgagaguggccugaaccgaaagaacauccaagacaacagggugcacugcugccuguacuucaucucacccuucggccaugggcuccggccauuggauguugaauucaugaaggcccugcaucagcgggucaacaucgugccuauccuggcuaaggcagacacacugacaccucccgaaguggaccacaagaaacgcaaaauccgggaggagauugagcauuuuggaaucaagaucuaucaauucccagacugugacucugaugaggaugaggacuucaaauugcaggaccaagcccuaaaggaaagcaucccauuugcaguaauuggcagcaacacuguaguagaggccagagggcggcgaguucggggucgacucuaccccuggggcaucguggaaguggaaaacccagggcacugcgacuuugugaagcugaggacaaugcugguacguacccacaugcaggaccugaaggaugugacacgggagacacauuaugagaacuaccgggcacagugcauccagagcaugacccgccugguggugaaggaacggaaucgcaacaaacugacucgggaaagugguaccgacuuccccaucccugcugucccaccagggacagauccagaaacugagaagcuuauccgagagaaagaugaggagcugcggcggaugcaggagaugcuacacaaaauacaaaaacagaugaaggagaacuauugauaauaggcuggagccucgguggccaugcuucuugccccuugggccuccccccagccccuccuccccuuccugcacccguacccccguggucuuugaauaaagucugagugggcggc

SEQ ID NO: 7363 - DNA, 1377 bp, Artificial Sequence
  Description of Artificial Sequence: Synthetic Transcript Sequence
atgatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 7364 - DNA, 1434 bp, Artificial Sequence
  Description of Artificial Sequence: Synthetic Transcript Sequence
atggaccgcagcctgggctggcagggcaacagcgtgcccgaggaccgcaccgaggccggcatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 7365 - DNA, 1410 bp, Artificial Sequence
  Description of Artificial Sequence: Synthetic Transcript Sequence
atgcccggcttctacagcgtgatgaccgacgaggagatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 7366 - DNA, 822 bp, Artificial Sequence
  Description of Artificial Sequence: Synthetic Transcript Sequence
atgatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggctacggccccagcctgcgcctgctggccccccccggcgccgtgaagggcaccggccaggagcaccagggccagggctgccac

SEQ ID NO: 7367 - DNA, 1479 bp, Artificial Sequence
  Description of Artificial Sequence: Synthetic Transcript Sequence
atgcgcagcagccccgccctgttcagcagccgcgccgccccccagaagccccgcaaggagggcagccaggccgccggcctgctggtgttcagcgacagcctggagatcaagcgcttcctggaggacaccaccgacgacggcgagctgagcaagttcgtgaaggacttcagcggcaacgccagctgccacccccccgaggccaagacctgggccagccgcccccaggtgcccgagccccgcccccaggcccccgacctgtacgacgacgacctggagttccgcccccccagccgcccccagagcagcgacaaccagcagtacttctgcgcccccgcccccctgagccccagcgcccgcccccgcagcccctggggcaagctggacccctacgacagcagcgaggacgacaaggagtacgtgggcttcgccaccctgcccaaccaggtgcaccgcaagagcgtgaagaagggcttcgacttcaccctgatggtggccggcgagagcggcctgggcaagagcaccctggtgaacagcctgttcctgaccgacctgtaccgcgaccgcaagctgctgggcgccgaggagcgcatcatgcagaccgtggagatcaccaagcacgccgtggacatcgaggagaagggcgtgcgcctgcgcctgaccatcgtggacacccccggcttcggcgacgccgtgaacaacaccgagtgctggaagcccgtggccgagtacatcgaccagcagttcgagcagtacttccgcgacgagagcggcctgaaccgcaagaacatccaggacaaccgcgtgcactgctgcctgtacttcatcagccccttcggccacggcctgcgccccctggacgtggagttcatgaaggccctgcaccagcgcgtgaacatcgtgcccatcctggccaaggccgacaccctgaccccccccgaggtggaccacaagaagcgcaagatccgcgaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggcccgcggccgccgcgtgcgcggccgcctgtacccctggggcatcgtggaggtggagaaccccggccactgcgacttcgtgaagctgcgcaccatgctggtgcgcacccacatgcaggacctgaaggacgtgacccgcgagacccactacgagaactaccgcgcccagtgcatccagagcatgacccgcctggtggtgaaggagcgcaaccgcaacaagctgacccgcgagagcggcaccgacttccccatccccgccgtgccccccggcaccgaccccgagaccgagaagctgatccgcgagaaggacgaggagctgcgccgcatgcaggagatgctgcacaagatccagaagcagatgaaggagaactac

SEQ ID NO: 7368 - DNA, 1380 bp, Artificial Sequence
  Description of Artificial Sequence: Synthetic Transcript Sequence
atgatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 7369 - DNA, 1437 bp, Artificial Sequence
  Description of Artificial Sequence: Synthetic Transcript Sequence
atggacagaagcctgggctggcagggcaacagcgtgcccgaggacagaaccgaggccggcatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 7370 - DNA, 1380 bp, Artificial Sequence; identical to SEQ ID NO: 7368
  Description of Artificial Sequence: Synthetic Transcript Sequence

SEQ ID NO: 7371 - DNA, 1413 bp, Artificial Sequence
  Description of Artificial Sequence: Synthetic Transcript Sequence
atgcccggcttctacagcgtgatgaccgacgaggagatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 7372 - DNA, 825 bp, Artificial Sequence
  Description of Artificial Sequence: Synthetic Transcript Sequence
atgatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggctacggccccagcctgagactgctggccccccccggcgccgtgaagggcaccggccaggagcaccagggccagggctgccactag

SEQ ID NO: 7373 - DNA, 1479 bp, Artificial Sequence
  Description of Artificial Sequence: Synthetic Transcript Sequence
tacagcagccccgccctgttcagcagcagagccgccccccagaagcccagaaaggagggcagccaggccgccggcctgctggtgttcagcgacagcctggagatcaagagattcctggaggacaccaccgacgacggcgagctgagcaagttcgtgaaggacttcagcggcaacgccagctgccacccccccgaggccaagacctgggccagcagaccccaggtgcccgagcccagaccccaggcccccgacctgtacgacgacgacctggagttcagaccccccagcagaccccagagcagcgacaaccagcagtacttctgcgcccccgcccccctgagccccagcgccagacccagaagcccctggggcaagctggacccctacgacagcagcgaggacgacaaggagtacgtgggcttcgccaccctgcccaaccaggtgcacagaaagagcgtgaagaagggcttcgacttcaccctgatggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 7374 - DNA, 996 bp, Artificial Sequence
  Description of Artificial Sequence: Synthetic Transcript Sequence
atggtggccggcgagagcggcctgggcaagagcaccctggtgaacagcctgttcctgaccgacctgtacagagacagaaagctgctgggcgccgaggagagaatcatgcagaccgtggagatcaccaagcacgccgtggacatcgaggagaagggcgtgagactgagactgaccatcgtggacacccccggcttcggcgacgccgtgaacaacaccgagtgctggaagcccgtggccgagtacatcgaccagcagttcgagcagtacttcagagacgagagcggcctgaacagaaagaacatccaggacaacagagtgcactgctgcctgtacttcatcagccccttcggccacggcctgagacccctggacgtggagttcatgaaggccctgcaccagagagtgaacatcgtgcccatcctggccaaggccgacaccctgaccccccccgaggtggaccacaagaagagaaagatcagagaggagatcgagcacttcggcatcaagatctaccagttccccgactgcgacagcgacgaggacgaggacttcaagctgcaggaccaggccctgaaggagagcatccccttcgccgtgatcggcagcaacaccgtggtggaggccagaggcagaagagtgagaggcagactgtacccctggggcatcgtggaggtggagaaccccggccactgcgacttcgtgaagctgagaaccatgctggtgagaacccacatgcaggacctgaaggacgtgaccagagagacccactacgagaactacagagcccagtgcatccagagcatgaccagactggtggtgaaggagagaaacagaaacaagctgaccagagagagcggcaccgacttccccatccccgccgtgccccccggcaccgaccccgagaccgagaagctgatcagagagaaggacgaggagctgagaagaatgcaggagatgctgcacaagatccagaagcagatgaaggagaactactag

SEQ ID NO: 7375 - DNA, 1380 bp, Artificial Sequence
  Description of Artificial Sequence: Synthetic Transcript Sequence
atgattaaaaggtttctcgaggacacaactgacgatggcgagctgtcaaagttcgtaaaagatttctccggcaatgcctcgtgtcaccccccagaagcaaagacctgggcaagtaggccccaagtgcctgaaccaaggccccaagcccccgacctctacgacgacgatttggaatttcgccctccctctcgcccccagtctagtgataaccaacagtacttctgtgccccagctccactgtctccttccgcaagaccgcgctccccgtggggcaagctggacccgtatgacagctccgaagacgataaagaatatgtaggtttcgccaccttgccaaatcaggtacatcggaagtcagtaaagaagggtttcgattttaccctgatggtcgccggcgagagtggcctcggcaagtccaccctagtgaattctctattcctaactgacctatacagggacagaaagctcctcggtgctgaagaacgcatcatgcagacagtggagattaccaagcacgccgtggatattgaggaaaaaggggtaaggctcagattaaccattgtggacacccccggtttcggagacgctgtcaataacactgagtgttggaagcccgtcgcagaatacatcgaccagcagtttgagcagtattttcgtgacgaaagtggacttaatagaaagaatattcaggacaatcgtgtccactgttgtctttacttcatttctccgtttggccatgggttacgcccactggatgtcgaattcatgaaagctctccatcaacgggtgaacatcgtgcctatcctcgcaaaggcggacacgctgacccctcccgaagtcgaccacaagaaacggaagatccgggaggaaatcgaacacttcggcattaagatctaccagtttccagactgtgactccgacgaggatgaagactttaagttgcaagaccaggccttgaaggagtcgatcccatttgcagtgatcggctcgaatactgtcgttgaggcccggggacgccgggtccgtggccgattgtacccctggggtattgtagaggttgaaaatccaggacattgcgatttcgtcaaactgaggaccatgcttgtacggacacacatgcaagatctgaaagatgtgaccagagagacacactatgaaaattacagggcacaatgcatccagtctatgactcgactggttgtgaaggaacgaaatagaaacaagctcacgcgtgaatccgggactgattttccaatccctgccgtcccgcctggcactgaccccgagactgagaagctgattcgcgagaaggatgaagaactgcggcggatgcaggagatgctgcataagatacagaagcaaatgaaagaaaattactag

SEQ ID NO: 7376 - DNA, 1437 bp, Artificial Sequence
  Description of Artificial Sequence: Synthetic Transcript Sequence
atggatcgaagcctcggctggcaaggaaactcagttcccgaggatcgtacagaggccgggatcaagagattcctggaagatacgacagacgacggcgagctgagtaagtttgtgaaagacttttccggtaacgccagctgtcacccgcccgaagctaagacgtgggcctctaggccgcaagttcccgagcctcggcctcaggccccagacctttacgacgatgacttggaattcagaccgcctagccgcccacagagtagtgacaatcagcagtatttttgcgcacccgcgccactctccccaagcgctaggcctcgatctccgtggggcaaactcgatccttatgatagttccgaggacgacaaagagtatgtgggtttcgccaccctgccaaatcaggttcatcgaaaatcggtgaaaaaaggtttcgattttacgctgatggtggccggagaatccggactgggtaagtccaccctagtcaatagtttgtttctcaccgacctctatcgggaccgaaaactgcttggagctgaggagcggattatgcagaccgttgagatcaccaagcacgccgtggatatcgaagaaaagggcgtcaggctgagactgaccatagtggatactcccggcttcggggacgctgtgaacaacacagaatgttggaagcccgtggccgaatacatagaccagcagttcgaacagtacttccgggacgagtcgggcctgaatcgaaaaaatattcaggacaatagggtgcactgctgtctgtactttatttcgccatttggtcacggcctgcgccccctagacgtggagtttatgaaggccttacaccagcgcgtgaacattgttccaatccttgccaaagccgacacattgactccccccgaagtcgaccacaagaaacgtaagattagagaagaaatcgagcacttcggaatcaagatttatcaattcccagactgcgattccgacgaggatgaggactttaagctccaggaccaggctctcaaggagtccatcccctttgcagttattggaagtaacactgtggttgaagccagggggagaagggtgagaggccggttatatccatgggggatcgtcgaggtggaaaatcctggacattgtgacttcgtcaagctgcgaacaatgctggtacggacacatatgcaggatttgaaggacgtgactcgcgaaacacactacgagaactatagagcccagtgcatccagtcgatgaccagattggttgtcaaagagcggaatcgcaataaattaacaagggaaagcggtacagattttccgatacccgcagtgccccctggaacagaccccgagaccgagaagctaatccgggagaaagatgaagagctgcgccggatgcaggaaatgttgcataagatacaaaagcagatgaaggaaaactattag

SEQ ID NO: 7377 - DNA, 1380 bp, Artificial Sequence
  Description of Artificial Sequence: Synthetic Transcript Sequence
atgattaaacgctttctggaggatactactgacgacggagagttatcaaagttcgtgaaagatttttcagggaatgcatcatgccaccctcctgaggccaagacgtgggcaagcagacctcaggttcccgaaccgcgtccccaggcacccgatctctacgatgatgacctggagttccgtcctccctcaaggccacagtcatctgacaaccagcagtacttctgcgcccctgctccattgtctccttctgcacggccgcgtagtccctgggggaagctggacccctacgactccagcgaggacgacaaggaatatgtgggcttcgctactctgcctaatcaggtgcaccgaaagtcagtaaagaagggatttgattttactctgatggtagccggtgagtctggattgggcaaaagtactcttgtgaactctctgtttctgacagatttgtaccgggatcgcaagttactcggcgccgaagaacgaatcatgcagaccgttgagatcactaagcatgcagttgatatagaggaaaagggagttaggctgagattgacaattgtggacactccagggttcggggatgccgtgaataacacagagtgctggaaacctgttgccgaatacatcgaccagcagtttgagcagtatttcagagatgagtcaggattaaaccgcaagaatattcaagacaacagggtccattgctgcctttacttcattagccccttcgggcacggccttaggcctctggacgttgagtttatgaaggccctgcaccagcgggtgaatattgtacccatcctcgctaaggcagacactttgacccctccagaggtggaccacaaaaagcgtaagattagggaagaaatcgagcactttggtataaagatctatcaatttccagactgtgattctgatgaggacgaggattttaagctgcaggatcaggctttgaaagaaagcatcccatttgccgtcattgggagcaacaccgtcgtcgaggctagaggccggcgtgtgaggggacgtctgtatccttgggggattgtcgaggttgagaatccgggtcactgcgattttgttaaactccgaacaatgctggttaggactcacatgcaggacctgaaggatgtaacgagggaaacacattacgagaactacagggcccagtgcattcagtcaatgacacgtctggtcgtgaaggaaagaaatagaaacaagctcacccgggaaagtggtacggatttcccaatcccagcggtgccaccaggaaccgatcctgagacagagaagctcatccgagaaaaagacgaagaactgcgccgaatgcaggaaatgttgcacaaaatccaaaagcagatgaaggagaattactag

SEQ ID NO: 7378 - DNA, 1413 bp, Artificial Sequence
  Description of Artificial Sequence: Synthetic Transcript Sequence
atgcccggcttttacagcgtgatgaccgacgaggaaatcaagcgcttcctggaagacacaacagatgacggagagttgagtaagttcgtcaaggacttctctgggaacgcgagttgtcacccgccagaggctaaaacctgggcctcaaggccacaggtgccagaacccaggccccaggccccagacctttacgacgacgacctagagttccgcccaccctctagaccacagagttccgacaatcagcagtatttttgcgcccctgccccactatcaccaagtgctcgtccacgcagcccatggggcaaactcgacccgtatgatagtagcgaggacgacaaggaatacgtagggttcgctacacttcccaaccaggtgcataggaagtcggtgaagaagggtttcgatttcaccctcatggtggcaggcgagtctggtcttgggaagtctacgcttgtgaattccctgtttctcacagacctatatcgcgaccgcaagctcctcggcgctgaggaaagaatcatgcagaccgtggagattacaaaacacgctgtcgatattgaggagaaaggagtgcggctccgacttacaattgttgatacgccaggatttggggatgcggtcaacaacactgaatgctggaagccggttgcagaatatatcgaccagcagtttgagcagtatttcagagatgaaagcggtttgaatagaaaaaacatccaagataatcgcgtccactgttgcctgtacttcattagcccctttgggcacggcctgcgccccctggatgtcgaattcatgaaggcactgcaccaacgcgtgaatattgtgccgatcctggcgaaggcggacaccctgactccccccgaggtggatcataagaaacggaagataagagaggagatcgagcatttcgggatcaaaatataccagtttcctgattgcgatagtgatgaagacgaagacttcaagctgcaagaccaggccctgaaagaatcgataccattcgccgtgataggctcaaataccgttgttgaagcacgggggcgacgggtacgcggcaggctttacccatggggaatcgtggaagtggagaaccctggacattgcgattttgtgaagttacgtaccatgctcgtgcgcacccatatgcaggacttgaaggacgtgacgcgtgaaacacactacgagaattaccgagcccagtgtatacagtccatgacaaggctggtcgtgaaggaacgaaatcggaataaactgactagagaatcaggcactgacttcccgattcccgccgtgccccccggcaccgacccggagacagaaaagctgattagagagaaagacgaagaactgcgaaggatgcaggagatgctacataaaattcagaagcagatgaaggagaactactag

SEQ ID NO: 7379 - DNA, 825 bp, Artificial Sequence
  Description of Artificial Sequence: Synthetic Transcript Sequence
atgattaagagatttctcgaagacaccactgacgatggggaactgtctaagttcgtgaaagatttctccggcaacgctagctgtcacccccccgaggccaagacttgggcatctcgtccacaggtgcctgaacccaggcctcaggcccctgatctgtacgacgacgatctggagtttagacctccaagccgaccccagtcatccgataatcagcagtacttttgcgcgccagcgccactgagcccctccgcacggccaaggtccccttggggtaagctcgacccatatgactcaagtgaggatgataaggagtatgtcggttttgccaccctcccaaatcaggtacatcggaagtcagtaaagaaaggcttcgatttcacactcatggtagctggagagtcgggcctcggaaagtcaaccttggtgaactcactctttctgactgacttgtatcgggatcgtaagctgctgggggccgaggagaggatcatgcaaacagtggagattaccaagcatgccgtggatattgaggaaaaaggtgttcgcctacgactgacaatcgtagatacccctggttttggagacgctgttaacaacaccgaatgctggaagccagtggctgagtacatagatcagcaatttgagcagtactttagggacgaatctggccttaatcggaagaatattcaggacaatcgggttcactgttgcctgtacttcatcagcccatttggtcacgggtatgggccaagtctccgcctcctggcccccccaggcgccgtgaaaggtaccggccaggagcatcagggccaagggtgccactag

SEQ ID NO: 7380 - DNA, 1479 bp, Artificial Sequence
  Description of Artificial Sequence: Synthetic Transcript Sequence
tattcttcaccagctctatttagttcccgggctgcaccacagaaaccgcgcaaagagggctcccaagccgctggcctcttggtttttagcgatagccttgagataaagcgtttcctcgaggacaccactgatgatggcgaactgtccaaattcgtgaaggatttcagcgggaacgcctcctgtcacccgcctgaggccaagacttgggcatctaggccacaagttccagagcccaggccccaggcccctgacttatatgatgacgaccttgagttccgaccaccttcaaggccacagtccagcgacaaccaacagtacttttgtgcacctgcgcccctctctccgtccgctaggccaagatccccatggggcaagctcgacccttatgacagcagcgaagatgataaggaatacgtgggtttcgccaccctgccaaatcaagtgcacagaaaatccgtgaaaaagggatttgatttcacactgatggtcgccggcgagtcagggctgggtaagagtacacttgtgaatagtctgttcctcacagacctgtatcgagacaggaaactgctaggtgccgaggagcgcatcatgcagaccgttgaaataacaaaacacgcagttgacatcgaagagaagggagtgcggctgcgcctcacaattgtggatacccctggcttcggcgacgccgtgaacaatactgagtgttggaaacccgtggccgaatacattgaccagcaattcgaacaatattttagagatgaatctggcctgaaccgaaagaacattcaggataatagggtacattgctgcctctactttatctccccttttgggcacgggttacggccactggatgttgaattcatgaaggcactacaccaaagagtgaacatcgtgccaattctggctaaggcggatacgctaacaccgccggaggttgatcataagaaaagaaagatcagggaagaaattgagcattttggcataaagatttaccagttcccagactgcgacagcgacgaagatgaagactttaagctccaagaccaggctctgaaggagtctattccgttcgctgtcattggcagcaacacagtggtcgaggccaggggcagacgggtgcgagggcggctctacccatggggcatcgtggaggtagagaatcccggtcactgtgatttcgtgaaattgagaaccatgctcgtgagaacccacatgcaagacctgaaagacgtgacccgcgagactcattatgaaaattaccgagcccagtgcattcagagtatgacgcgtctggtcgtaaaggagcgcaaccggaataaactcactcgggagagtggaacggactttcctattcctgcagtaccaccaggtacggatccagagacagagaaactgattcgggagaaagacgaggagctcagacggatgcaggagatgctacataaaatccaaaagcaaatgaaagagaactactag

SEQ ID NO: 7381 - DNA, 996 bp, Artificial Sequence
  Description of Artificial Sequence: Synthetic Transcript Sequence
atggtcgcgggggagtctgggcttggcaaaagtacactagtgaacagcctttttcttacagacctgtatagggacagaaagctgctgggcgcagaggagcgaataatgcagacagtggagatcacgaagcacgccgttgatattgaggaaaagggggtgcggctccgccttacaattgtggatactccaggctttggtgacgccgtgaataacactgaatgctggaaaccggtggccgagtacattgaccaacagttcgagcaatatttccgggacgagagtggccttaatcggaagaacatccaagacaaccgcgttcattgttgtctctactttatctcaccattcgggcacggattgaggcccctggatgttgaatttatgaaagctttacatcaacgggtgaacatcgttcccatcctggcaaaggccgacaccctcacaccacctgaggtcgatcacaaaaagagaaaaattcgtgaggagattgagcacttcggaattaaaatctaccagtttcccgactgtgacagcgacgaggacgaggacttcaagttgcaggaccaagctctgaaggaaagcattcccttcgccgttatcggtagcaacaccgtcgttgaggcaagaggacgccgggttagaggccgcctttatccctgggggattgtggaggtcgaaaacccaggccactgtgacttcgtgaagctgcgcacgatgctagtccgcacacacatgcaggatcttaaggatgtgacccgtgaaacacactacgaaaattatagagctcagtgtattcagtctatgacgcgcctcgtggtgaaggagcgaaatcgcaataaactgacacgcgagtcagggacagacttccccattccagcggtgcctcccggaacagacccagaaacagagaaattgatccgcgagaaagacgaggagcttcgaaggatgcaggagatgctgcacaaaattcagaagcagatgaaggagaactattag

SEQ ID NO: 7382 - DNA, 1380 bp, Artificial Sequence
  Description of Artificial Sequence: Synthetic Transcript Sequence
atgatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggcagaagagtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 7383 - DNA, 1437 bp, Artificial Sequence
  Description of Artificial Sequence: Synthetic Transcript Sequence
atggacaggagcctgggctggcagggcaacagcgtgcctgaggacagaacagaagctggcatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 7384 - DNA, 1380 bp, Artificial Sequence; identical to SEQ ID NO: 7382
  Description of Artificial Sequence: Synthetic Transcript Sequence

SEQ ID NO: 7385 - DNA, 1413 bp, Artificial Sequence
  Description of Artificial Sequence: Synthetic Transcript Sequence
atgcctggcttctacagcgtgatgacagatgaggagatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 7386 - DNA, 825 bp, Artificial Sequence
  Description of Artificial Sequence: Synthetic Transcript Sequence
atgatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggctacggccccagcctgcggctgctggcccctcctggagctgtgaagggcaccggccaggagcaccagggccagggctgccactag

SEQ ID NO: 7387 - DNA, 1479 bp, Artificial Sequence
  Description of Artificial Sequence: Synthetic Transcript Sequence
tacagcagccctgccctcttcagcagcagagctgccccccagaagcccaggaaggagggcagccaggccgccggcctgctggtgttcagtgacagcctggagatcaagcgcttcctggaggacaccacagatgatggagagctgagcaagtttgtgaaggacttctctggaaatgccagctgccaccccccagaggccaagacctgggccagccggccccaggtgcctgagccccggccccaggccccagacctgtatgatgatgacctggagttccggccccccagccggccccagagcagtgacaaccagcagtacttctgtgccccagcccccctgagccccagcgcccggcccaggagcccctggggcaagctggacccctatgacagcagtgaagatgacaaggagtatgtgggctttgccaccctgcccaaccaggtgcacaggaagtctgtgaagaagggctttgacttcaccctgatggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgaaagtggcctgaacaggaagaacatccaggacaacagagtgcactgctgcctgtacttcatcagcccctttggacatggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggccggcgggtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 7388 - DNA, 996 bp, Artificial Sequence
  Description of Artificial Sequence: Synthetic Transcript Sequence
atggtggccggggagagcggcctgggcaagagcaccctggtgaacagcctcttcctgacagacctgtacagagacaggaagctgctgggcgctgaggagcgcatcatgcagacagtggagatcaccaagcatgctgtggacatcgaggagaagggcgtgcggctgcggctgaccatcgtggacaccccaggctttggagatgctgtgaacaacacagagtgctggaagcctgtggccgagtacatcgaccagcagtttgagcagtacttcagagatgagagcggcctgaacaggaagaacatccaggacaacagagtgcactgctgcctgtacttcatcagccccttcggccacggcctgcggcccctggatgtggagttcatgaaggccctgcaccagagggtgaacatcgtgcccatcctggccaaggctgacaccctgaccccacctgaggtggaccacaagaagaggaagatccgggaggagattgagcacttcggcatcaagatctaccagttcccagactgtgacagtgatgaagatgaggacttcaagctgcaggaccaggccctgaaggagagcatcccctttgctgtgattggcagcaacacagtggtggaggcccggggcagaagagtgcggggccgcctgtacccctggggcatcgtggaggtggagaaccctggccactgtgactttgtgaagctgcggaccatgctggtgaggacccacatgcaggacctgaaggatgtgacccgggagacccactatgagaactaccgggcccagtgcatccagagcatgacccggctggtggtgaaggagaggaacagaaacaagctgacccgggagagcggcacagacttccccatcccagctgtgcccccaggcacagatcctgagacagagaagctgatccgggagaaggatgaggagctgcggaggatgcaggagatgctgcacaagatccagaagcagatgaaggagaactactag

SEQ ID NO: 7389 - DNA, 1380 bp, Artificial Sequence
  Description of Artificial Sequence: Synthetic Transcript Sequence
atgatcaagcggttcctggaggacaccaccgacgacggcgagctgtccaaatttgttaaggattttagcggcaatgcgtcctgtcaccccccagaagccaagacttgggcctcccgaccacaagtacctgaaccccgtccccaggcgccagacctgtatgatgacgatttggaattccggcccccatctcggccacaaagctctgacaatcagcagtatttttgcgccccagccccactctcacccagcgcgagacccagatctccgtgggggaagctagacccatatgacagctcggaggacgataaggaatacgtagggtttgcgacattgccaaatcaggtacaccgcaaatccgtaaagaagggttttgacttcacattgatggtcgccggcgagagcggtctggggaaatcgaccctggtcaattccctttttctgacggacctatacagagacagaaagttgctcggggccgaggaacggattatgcagacagttgagatcacaaagcacgccgtggacatcgaggaaaaaggcgtgcgtctgcggctgaccatcgtggatacccctggctttggtgacgccgtgaacaacaccgagtgctggaaaccagtcgctgaatacatagaccagcagttcgagcaatattttagagacgaaagcggactgaatcgaaaaaacattcaggacaaccgggtacactgctgcctgtatttcattagcccgtttggacacggcttgaggccactggacgttgagtttatgaaagcgctacaccaacgcgtaaacatcgtcccaatcttggcaaaggccgatacgttgacacctcctgaggttgatcataagaagagaaaaatcagagaggagatcgaacatttcgggatcaagatctaccaatttcctgattgcgattccgatgaagatgaagacttcaagctccaggatcaagcattaaaggaaagcattccatttgcagtcatcggctccaacacggtggtcgaggccagaggaagacgcgtgcgcggccgtctgtatccctggggcattgttgaagttgaaaacccaggacactgcgattttgtgaaactgcgtacaatgctcgtaaggacacacatgcaggatttgaaagacgtgaccagggaaacacattacgagaactaccgagcccagtgcatccaatccatgacccgattagttgtgaaagagcgcaatagaaacaagttaacccgtgagtccggcaccgacttccccatacccgcggttcccccgggcacggacccagagaccgaaaagctcatccgggagaaagacgaagaactgagacggatgcaggagatgctgcacaaaattcagaaacagatgaaggagaattattag

SEQ ID NO: 7390 - DNA, 1437 bp, Artificial Sequence
  Description of Artificial Sequence: Synthetic Transcript Sequence
atggaccggagcctgggctggcagggcaacagcgtgcccgaggacagaaccgaagctgggataaaacggtttctggaggatacaaccgacgacggcgagttgtcgaagtttgtcaaggacttcagcggcaatgcatcctgtcatccccctgaggcaaaaacctgggcctcgagacctcaagtgcccgaacctcgaccccaagcccctgacctatatgatgacgatctagaatttcgtccgccgagcagaccacaatcaagcgataatcagcagtacttttgtgctcctgctccactgtccccgtccgctcgcccgcgaagtccttggggtaaactcgacccctatgactcatcggaagatgacaaggaatacgtgggatttgcaacacttcctaaccaagtccaccgaaagtctgttaagaaaggctttgattttaccctcatggtggccggggaatccggcttgggcaagtcaacactcgtgaacagcctgttcctgaccgacctctacagggacagaaagctattaggcgctgaagaacggataatgcagactgtggaaattacaaagcatgccgttgacattgaagaaaagggtgtccggctgcgtctgaccattgttgataccccaggctttggcgacgcggtaaacaacactgagtgctggaagcctgttgcggaatatattgaccagcagtttgaacaatatttccgcgatgaaagtggcctgaaccgcaagaatattcaggataaccgcgtccactgctgcctgtactttattagtcccttcggtcacgggctcaggcccctagacgttgagttcatgaaggccttgcaccagcgggtgaacatagtgcccattctggccaaggccgataccctcacaccaccagaggtagaccacaagaagagaaaaatcagggaagagatagagcactttgggattaagatctatcagtttccggattgtgatagtgatgaggacgaggactttaaacttcaagaccaagctctgaaagagtctattccattcgcagtgattggctccaataccgtggtcgaggctcgaggccggagagttcgggggaggctgtacccttggggcatcgtcgaggtcgaaaatcctggacactgcgattttgtcaagttgaggacgatgctcgttcggacccacatgcaggacctgaaggatgtcaccagagaaacacactatgaaaattaccgggcccagtgcatacagtctatgacccgactggtggtgaaagagcggaatcgcaacaagctgacccgagagtcaggcaccgacttccctataccagctgtcccacctggcactgatccggaaaccgaaaaattgattcgcgagaaggacgaggagctgagaaggatgcaggagatgctgcataaaatccaaaagcagatgaaggagaactattag

SEQ ID NO: 7391 - DNA, 1380 bp, Artificial Sequence
  Description of Artificial Sequence: Synthetic Transcript Sequence
atgatcaagcggttcctggaggacaccaccgacgacggcgagctgagcaagttcgtaaaggatttctccgggaacgcatcatgtcaccccccggaagcaaaaacttgggcctcccgcccacaggtacccgaacctaggcctcaggctccagatctgtacgacgacgacctggagttcagacctcccagccgcccccagtctagcgacaaccagcagtatttttgcgcgcccgccccactctctcccagcgctcgacccagaagtccttggggcaaattggacccttatgactcttcagaagatgacaaggaatacgtaggtttcgctactttacctaatcaagtgcatagaaaaagtgtcaagaaaggattcgacttcacgctcatggtggctggcgagagtgggctggggaagagcactctggtgaatagtctgttcctcactgatttgtatcgcgacagaaaactcctgggagcagaggagaggattatgcagactgtcgaaataaccaagcatgccgtggacatcgaagagaagggggtcagactgcgactaacaatagttgacacacccggtttcggagacgcggtaaataatacagaatgctggaagcccgtggcagaatacattgaccagcagttcgaacagtatttccgcgatgagtcaggcctgaaccgcaagaacatccaggacaatcgcgtgcactgttgcctgtatttcatctctccatttggtcacggcctccggcccctggacgtagagttcatgaaagccctgcatcaacgcgtgaacattgtcccaatattggcgaaggctgatactctgacaccacctgaggtggaccacaagaaaagaaaaatcagggaagaaatcgaacactttggcattaaaatttaccagttcccggattgtgactccgatgaagacgaagatttcaaactccaagaccaagcacttaaagaaagtattccctttgccgtgatcggcagcaataccgtcgtagaagcacggggacgacgagttaggggtagactttacccttggggcatcgtggaggtggagaacccaggtcactgcgatttcgtcaaactgagaactatgcttgttcgcacgcacatgcaggatctcaaagacgtcacaagggagacacactacgaaaactatcgagcccagtgtattcagtccatgactcggcttgtggtgaaagagaggaacagaaataagctgacacgcgagtctggcaccgactttcctatcccagccgtgcctcccggcactgacccggagaccgagaaactgatcagggagaaggacgaggaactgaggagaatgcaagaaatgcttcataaaatccagaaacagatgaaggaaaattactag

SEQ ID NO: 7392 - DNA, 1413 bp, Artificial Sequence
  Description of Artificial Sequence: Synthetic Transcript Sequence
atgcccggcttctacagcgtgatgaccgacgaggagatcaagcggttcttagaagataccaccgacgatggggagctgtcaaaattcgtgaaagacttttcggggaacgcgagttgccaccccccggaggcaaaaacctgggcttcacgaccccaggtgcccgaacctagaccccaggcccccgatttgtatgatgatgatttagagtttagaccgccatcccgcccccaatcttctgataatcagcagtacttttgcgccccagcacctttatctccaagcgctcgcccccggtccccttggggaaaactcgatccttacgactcgagcgaagacgacaaagagtacgttggattcgcaaccctgccaaaccaggtacacagaaagtcagtcaagaagggattcgacttcacactcatggtagccggcgaaagtgggttaggaaagtccaccctagtgaacagtttattcctcaccgacctctaccgggaccgtaaactgctcggggccgaagaacgaatcatgcagacagttgagattacaaagcacgccgttgacattgaggagaagggagtgcggctgcgtcttaccattgtcgatacgcccggattcggagacgctgtgaacaatacagaatgttggaagccggtggcagaatatatcgatcagcaatttgaacagtacttcagggatgagtccggacttaaccgcaagaacatacaagacaatagggtgcattgttgtctgtactttattagcccttttgggcatggtctgagacccctcgatgtcgagttcatgaaagcgctccaccagcgcgtgaacattgtccccatcctcgctaaggccgataccttgacccctcccgaagtggatcacaaaaaacggaagattcgcgaggagatcgagcactttggcattaaaatataccagtttcccgactgcgactcagacgaagatgaagacttcaaactccaggaccaggctctcaaagagagcatccccttcgcagttatcgggagcaatacagttgtagaagccagagggagaagagtccgaggccgcttgtacccctggggaattgtggaggttgaaaaccctggacactgcgattttgtgaaactgaggaccatgcttgttcggacccatatgcaggatctgaaggatgtcacccgggagacacattacgagaactatcgcgcacagtgcattcagagcatgacacgcctcgtcgtaaaggaacgcaatcggaataagttgacccgcgaaagtggcaccgacttccctatccccgcggtgcccccggggacagaccccgaaaccgagaagctgatcagagaaaaggacgaggaacttcgacggatgcaggaaatgttacacaaaatccagaagcagatgaaagagaattattag

SEQ ID NO: 7393 - DNA, 825 bp, Artificial Sequence
  Description of Artificial Sequence: Synthetic Transcript Sequence
atgatcaagcggttcctggaggacaccaccgacgacggcgagctgagtaagttcgtgaaggattttagcggtaatgcctcatgccaccctccggaggcaaaaacctgggctagccgtcctcaggtgccagaaccacgaccccaggcccccgatctgtatgatgacgacctggaatttagacccccatcccgcccacaatcatccgacaaccagcagtacttttgtgcccctgcacctctgtccccctctgctcggccgagaagcccatggggaaagctggacccttacgacagcagcgaggatgataaagagtatgttggctttgcaacactcccgaaccaggtccacaggaagagcgtaaagaaaggatttgatttcacactcatggtggccggggaaagcggattgggaaagtccacactggtgaactcactattcttaacagacctttaccgtgatagaaagcttctgggtgcagaggagcgcattatgcaaaccgtcgaaatcactaaacacgctgtggacatcgaggaaaaaggggtgcgacttcgactcactatcgtcgatactcccggttttggggacgccgtgaacaataccgaatgctggaaacctgtggccgaatacatcgatcaacaattcgaacaatactttcgggatgaaagcggactcaatagaaaaaatatacaggacaacagagtccattgttgtttatactttatcagccctttcgggcacggatatggtccgagcctgcgcctgctcgcacctcccggcgccgtgaaggggaccggccaggagcaccaggggcagggatgccactag

SEQ ID NO: 7394 - DNA, 1479 bp, Artificial Sequence
  Description of Artificial Sequence: Synthetic Transcript Sequence
tacagcagccccgccctgttcagcagccgggccgccccccagaagccgaggaaagaaggcagccaggcggccggactgttggttttttctgactctctggagattaagaggttcctcgaagacaccaccgacgatggagagctgtctaagttcgtgaaggatttttcaggcaatgcctcttgccatccacccgaagcaaaaacctgggcctcccgcccccaggttcccgaaccccgcccacaggctccagacttgtacgatgatgatctggagttcagaccaccatcacgaccccagtcttctgataaccagcaatacttttgcgctcccgccccactgagtccgtccgctagaccccgcagcccctggggcaagttagacccctatgattcttctgaagacgacaaagaatatgtcggtttcgctaccctacccaatcaggttcatcgcaagtctgttaagaagggcttcgacttcacgctcatggtcgctggcgaatccgggctaggcaagagtactctggtaaacagcctgtttctcactgacctgtaccgagaccggaagttgttaggggcggaagaacggattatgcagacggtggaaatcaccaaacacgccgtcgacattgaagagaaaggggtgaggctgcgccttaccatcgtcgacacgccaggttttggagacgccgtgaataacacagaatgttggaagccagtggccgagtatatagaccaacagtttgagcaatattttagggacgagagtggactgaaccgcaagaatattcaggataaccgcgttcactgttgtctctatttcataagtccttttgggcatggcttgcgaccgctcgatgtggagtttatgaaagctttacatcagcgcgtgaacattgttcccatcttggccaaagccgataccctgacacctcctgaggtggatcacaagaaaaggaagatccgtgaggaaatcgagcatttcggcattaaaatatatcagtttccagactgtgactcagacgaggatgaagactttaagctgcaagaccaggctctgaaggaaagcatcccctttgcagttattgggtctaatacagttgtggaggctagagggaggcgcgtgcgggggagactgtatccgtggggaatcgtcgaagtggaaaacccaggacattgtgattttgtcaaactgcgtacaatgctcgtgaggacgcatatgcaggacttgaaggacgtgacgagggaaactcactacgaaaattatcgtgctcagtgcatccagagcatgacacggcttgtagtgaaggaaagaaatagaaacaagctaaccagggagagcggcacggatttcccaatccctgctgttccgcctggcactgaccccgaaactgaaaagctgatccgcgaaaaagacgaagaactgcgccgtatgcaggagatgctgcacaagattcagaagcagatgaaggagaactattag

SEQ ID NO: 7395 - DNA, 996 bp, Artificial Sequence
  Description of Artificial Sequence: Synthetic Transcript Sequence
atggtggccggcgagagcggcctgggcaagagcaccctggtgaactcactctttctgaccgacctatatcgagaccgcaagctgttgggtgctgaagaaaggataatgcagacagtagagattacaaaacacgcggtggacatcgaagagaaaggggttaggctccgcttgaccattgtggacacacctggatttggggatgcagttaacaatactgagtgctggaaaccggtggccgagtacatcgaccaacaattcgagcagtatttccgagacgaaagcggacttaaccggaagaacattcaagataatcgcgtgcactgttgtttgtatttcatttctcctttcggtcatgggttgagaccgctcgacgtcgagttcatgaaggcccttcaccaaagggtcaatatcgttcccattctggctaaagccgacaccctcaccccccccgaagtcgaccataaaaaacggaagatcagggaagagatcgaacactttggaataaagatatatcaattccccgactgcgacagtgatgaggacgaggattttaagctgcaagatcaggctttaaaggagtccatcccctttgccgtcatcggcagtaatactgtggtggaagcaagaggccggagggtgaggggccgactatatccatggggaattgtggaggtggaaaatcccggccattgcgatttcgttaaactgcgaactatgcttgttcggacgcacatgcaggacctaaaagatgtcacccgggagactcactatgagaactaccgcgcacagtgtatccaatctatgacccgcctggtggttaaagagcgaaacaggaataagttaacacgtgaatcgggcactgacttccccattcccgctgtgccgcccgggacagaccccgagacggaaaagctgataagagaaaaggatgaggagctgaggcgcatgcaggagatgctccacaagatacagaaacagatgaaggaaaattactag

SEQ ID NO: 7396 - DNA, 1380 bp, Artificial Sequence
  Description of Artificial Sequence: Synthetic Transcript Sequence
atgatcaaaaggtttcttgaggataccaccgacgatggcgaactgtcaaaatttgtcaaggactttagcggaaatgctagctgtcatcctcctgaggctaagacgtgggccagccggcctcaggtgccggagccacggccacaagcccctgatctgtacgatgacgacttggagttcagaccaccatcgagacctcaatcctccgataatcaacagtacttctgtgccccagccccactctccccttctgcacgaccacgttcaccctgggggaagttggatccatacgactcgagtgaggatgacaaggagtacgttggctttgcaacactccccaaccaagtccacagaaagtccgtcaagaaggggttcgatttcaccctcatggtggcgggagagtcaggcttgggcaagtctacactcgtaaacagcctatttctgaccgatctgtacagggatagaaagctgttgggtgccgaagaacgcatcatgcagaccgtcgagatcaccaaacatgccgttgatatcgaagaaaaaggagtacgcctaagacttaccatcgtggataccccaggctttggagacgccgtcaataataccgagtgctggaaaccagtagctgagtacatcgatcagcagtttgaacaatacttccgtgacgagagtggacttaacagaaagaatatccaggataatcgagtgcactgttgcctttatttcatttctccatttggccatggattgagaccgctggatgtggaatttatgaaagcgctccatcaaagggtgaacatcgtgccgattttagctaaggcagacacgctgactcctcccgaggtggatcacaagaaacgtaagattcgggaggagatcgaacatttcggaatcaaaatctaccagtttcctgactgtgattctgacgaggacgaggattttaaactccaagaccaggcactgaaggagtccatcccattcgctgttatcgggtccaatacggttgtggaggcgaggggcaggcgcgttcggggacggctctacccttggggaatcgtcgaggtggagaacccaggacattgcgactttgtgaaattacggactatgctggtgagaacccacatgcaagatctgaaggatgtgacccgggagacacactacgaaaactatcgcgctcagtgtattcagtctatgacccgcctggtggtgaaagagcgcaatcggaataaactcacacgggagtcagggactgacttcccaattccagccgtgccccctggcacagatccagagactgaaaagttaattcgggagaaggatgaggaactgcggcgaatgcaggaaatgctgcacaagatccagaaacagatgaaggaaaactactag

SEQ ID NO: 7397 - DNA, 1437 bp, Artificial Sequence
  Description of Artificial Sequence: Synthetic Transcript Sequence
atggaccgcagcctgggatggcaaggtaattctgtgcctgaggacagaacagaagcaggaataaaaaggttcctcgaggacaccaccgacgatggtgagctgagcaagtttgtgaaagacttcagcggcaacgcctcgtgtcatcctccagaggccaagacctgggcatcccggcctcaggttcctgagccccgtcctcaagcaccagacctgtacgacgatgacctcgaattccgccctcccagccgccctcaatcgtccgacaaccagcagtatttttgtgctcccgctcccctctctccaagtgcacgtcccagaagtccttggggcaagctagacccctatgatagttctgaagacgacaaggaatacgtgggatttgcaaccctgcccaaccaggtacaccggaaatccgtgaaaaagggcttcgatttcaccttgatggtggctggggagagcggtttgggcaaatcgactctggtcaacagtctgttcctgaccgacctgtatcgggaccgtaagctgctgggggcagaagaaagaataatgcagacggtggagataacaaagcatgcagtcgatatagaggaaaagggagtgaggctgcgcttaactatcgtggatactccaggtttcggtgacgcggtgaataataccgagtgttggaaaccagtggccgagtatatcgatcaacaattcgaacagtattttcgggatgagtccggcctgaataggaagaacatacaagacaaccgagtccactgttgcctgtattttatcagtcccttcggacacggattacgccctttagacgtcgagttcatgaaggcacttcaccaaagagtgaatattgttccaattctcgccaaggccgacacactgacgcctcccgaagtcgaccacaagaaaagaaaaatacgtgaagaaatagagcacttcgggattaagatctatcagttccctgattgcgacagcgatgaagacgaggacttcaagctgcaagatcaggccttgaaagaatccattccttttgcggtgatcggctctaacacagtggttgaggcccgaggtagacgtgttcggggtcggctgtacccatgggggatagttgaggtcgagaaccctggtcactgcgatttcgttaagttgcgcaccatgctggtgcgtacacacatgcaggaccttaaagatgtaacccgtgagacacattatgagaattacagggcgcagtgcatccagtctatgaccaggcttgtggtgaaagagcgaaatcgcaataaattaacccgtgaatctggaaccgacttccctatcccagccgtaccccctggaactgatcccgagaccgaaaagctcattcgcgagaaagatgaagaactaagacgaatgcaggaaatgctgcataagatccaaaagcagatgaaagaaaactactag

SEQ ID NO: 7398 - DNA, 1380 bp, Artificial Sequence
  Description of Artificial Sequence: Synthetic Transcript Sequence
atgatcaagagattccttgaggatactacagatgacggggagctgtctaagtttgtgaaagatttcagcggaaacgcctcttgtcatccaccagaagcaaagacgtgggcctcacggcctcaggtgcctgagccaaggcctcaggccccagacctgtatgacgacgaccttgagttcaggcctccttctagacctcaatccagtgataaccagcagtacttttgcgctccagcccctcttagtccaagcgccagaccacgaagcccctgggggaagttagatccctatgatagttccgaggacgacaaggagtacgtgggcttcgccactctcccaaaccaagtgcatcgaaagtcagtcaagaagggtttcgactttacactcatggtggcgggtgagtccggactgggaaagagcacactcgtgaatagcttattcctgaccgacctgtatcgggatcgcaagctgctcggagccgaagagagaataatgcagactgtggagatcaccaagcacgcagtagacattgaagaaaagggagtcagactacgcttgacaatcgtcgatactcccggatttggcgacgcagtgaataacaccgagtgctggaagcccgtggccgaatatatcgaccagcagtttgagcagtatttccgggacgagagtggactgaaccggaagaatatccaggacaatagagtacactgttgcctctacttcatctcccccttcggacacggcctcaggccactggatgtagagtttatgaaagccttacaccagcgggtcaacatcgtgccaatcctggccaaggcagatacactcaccccacctgaagtggatcataaaaaaagaaagatccgcgaagaaattgagcacttcgggattaagatttaccagttccccgattgcgactccgatgaggacgaggattttaaactgcaggatcaggctctgaaagagtccataccttttgctgtgataggtagcaacaccgtagtggaggcccgagggagacgcgtgagaggcaggctgtacccttggggcattgtcgaggttgagaacccgggacactgcgactttgtgaagttaaggactatgctggtgcggacccatatgcaggacctgaaagatgtgacccgggaaacccattacgaaaactatagagcccaatgcattcaaagtatgacaagactggttgtgaaagagcggaataggaacaaattgacacgggaaagcggcactgattttcctatcccagccgtgcccccagggacagatcctgagaccgagaaactcatccgggaaaaggacgaagaattacgccgtatgcaggaaatgctccataagatccagaagcagatgaaagaaaattattag

SEQ ID NO: 7399 - DNA, 1413 bp, Artificial Sequence
  Description of Artificial Sequence: Synthetic Transcript Sequence
atgcctggattctatagtgtcatgactgatgaggagattaagcgctttctggaggataccactgatgacggagagctgagtaaatttgtgaaggattttagcggtaatgcttcgtgccatcccccagaggccaagacatgggcctctaggccacaagtcccggagcctagaccacaggccccagatctctacgatgatgatctggagttccggcctccgtcccgaccacagtcctcagacaatcagcaatatttctgtgctccggcaccactctcccctagtgccagacctcgcagcccttggggcaagttggatccttatgactccagcgaagatgacaaagaatatgttggatttgccaccctgcccaatcaggtgcatagaaaatccgtcaagaaggggtttgatttcactttaatggtagctggcgagagcgggctgggtaaatcaacacttgtgaattcattattcctgacggacctgtatcgggacaggaaattactgggggctgaggaacggattatgcagacggtcgaaattacgaagcacgcggttgatatagaggaaaaaggggtccggctgagactgactatcgttgacacacctggctttggagacgctgttaataatacagaatgttggaagcccgtggcagagtatatcgatcagcagtttgagcagtatttccgcgatgagagcggcctgaatagaaaaaacatccaagacaatcgtgttcactgctgcctgtactttatcagtcccttcggccacggcctccggccactagacgttgaattcatgaaagctttacaccaaagagtgaacatcgttccgatccttgcaaaggcagacaccctgacaccgccagaagtggaccacaagaaaagaaaaattagagaagagattgagcacttcggcataaagatttaccagtttccagattgtgactccgacgaagacgaggatttcaagctccaagatcaggcactcaaagagagcatcccttttgccgtcatcggctccaataccgtggtggaggctcgtggcagaagagtccgcggacgtctgtacccttgggggattgtcgaagtcgaaaaccctggtcattgtgactttgtgaaattgcgtaccatgctggttcggacccatatgcaggacttaaaagacgtgactagggagacccactacgaaaattatagagcacagtgcatccaaagtatgacccggttagtggtgaaggaaaggaatagaaataagctcaccagagagtccgggaccgatttcccaattccagccgttcccccaggtactgaccccgagaccgaaaagttgattagagagaaagacgaggagcttcgacgcatgcaagaaatgctccataaaatccagaaacagatgaaggagaactactag

SEQ ID NO: 7400 - DNA, 825 bp, Artificial Sequence
  Description of Artificial Sequence: Synthetic Transcript Sequence
atgataaaaaggtttctggaagataccacagatgacggagagctatccaaattcgtcaaagacttttcgggaaacgctagttgtcacccaccagaggccaagacgtgggcatccaggccccaggtgccagaaccgagacctcaggccccagatctgtatgacgacgacttggaatttcgcccaccgagtcgccctcaatctagtgataatcagcaatatttttgcgcgccagccccactttccccctctgcaaggcccagaagtccctggggcaagttggacccgtacgattccagcgaggatgacaaggaatatgttggcttcgcaactcttccaaatcaggtgcacagaaagagtgtgaagaaaggatttgactttacactcatggtcgctggcgaaagcgggctgggcaaatccacactggtaaactctttgtttctgaccgatctctaccgcgacaggaaattgttaggagctgaggagcgcattatgcagactgtggaaatcaccaagcatgctgtggacattgaagagaagggagtcaggttgcggctgactattgtggataccccaggattcggagatgccgtgaataatactgaatgttggaaaccggtcgccgaatacatcgatcagcagttcgaacaatattttcgtgacgagtccggattaaaccggaagaacatacaagataaccgtgttcactgctgtctgtacttcatatcacccttcgggcatggttatggcccttccctccggctccttgcgccacccggtgccgtcaaggggacaggccaagagcaccaggggcaaggctgccactag

SEQ ID NO: 7401 - DNA, 1479 bp, Artificial Sequence
  Description of Artificial Sequence: Synthetic Transcript Sequence
tactcttccccggcactcttctcatcaagagcggctcctcagaagcctaggaaggagggatcccaggccgctgggttacttgtgtttagcgatagtctggagattaagcgattcctggaagacacaaccgatgacggggagttaagtaagttcgtgaaggatttttccgggaatgccagctgccatccacccgaagctaaaacttgggcgtcccggccacaggtccctgaacccagacctcaggcaccagacttgtacgacgacgatctggagttcaggccaccatcacgcccacagtccagtgataaccagcagtacttctgcgccccagccccactgtcaccatcggctcgcccaagatccccctggggaaagctcgatccatatgactcctctgaggatgacaaagaatatgtggggtttgctacgctgcctaatcaggttcatcggaaatctgtaaaaaagggttttgactttaccctgatggtggccggtgaaagtggacttggtaagagtaccctcgtgaattccctgtttctgacagatctgtaccgggaccgcaaactgttgggagccgaggaaagaatcatgcagacagtagagattacaaaacatgccgtggatatcgaggagaaaggcgtgcgcctccggttgaccatcgttgatacccctggcttcggagacgcagtgaacaacacggagtgctggaagcctgtggccgagtatatcgaccagcaattcgagcagtacttccgggatgagtccggtttgaataggaagaatatccaagataaccgcgttcattgctgtctgtattttataagcccattcggtcatggactccggccacttgatgttgaatttatgaaggcgcttcaccaacgagtgaatatcgttccaatcctcgccaaagcggatacccttactcctcccgaggtcgaccataaaaagcgcaagatcagggaggaaatagaacatttcggaatcaaaatataccagtttcctgactgtgactctgacgaggacgaggacttcaagttgcaggatcaagcgctcaaagaaagtattccgttcgcggtgatcgggtctaacaccgtcgtggaagcaagaggcaggagggtgagaggcagactgtatccttggggtatcgtcgaagtggaaaacccaggacactgtgactttgttaagcttcggacaatgctggtaagaactcacatgcaggatctgaaggacgtcacgagggagacccattacgagaattaccgcgctcagtgcatccagagcatgactcgacttgtggtaaaggagaggaatcgcaacaagctgactcgggagagcggaactgactttcccatacccgcagtgccaccgggaaccgacccagagacagaaaagctgatcagagaaaaggacgaggagctgcgcagaatgcaggagatgctgcacaagatacaaaagcaaatgaaggagaactactag

SEQ ID NO: 7402 - DNA, 996 bp, Artificial Sequence
  Description of Artificial Sequence: Synthetic Transcript Sequence
atggtggcaggagaatccgggctgggcaaatctacactcgtgaactcactgtttctcactgatttgtatcgcgaccggaaactacttggggctgaagagcgcataatgcagactgtcgagatcacaaagcatgccgttgatattgaagaaaagggggtgcggttacgactcaccatcgttgataccccaggcttcggtgacgcagtgaacaataccgagtgttggaaaccagtggcagaatacatcgaccaacaatttgagcagtatttccgggatgaatctgggcttaacagaaagaatattcaagacaatagagttcactgttgtctctatttcatttctccctttgggcacgggcttaggccgctggatgttgaattcatgaaggctctacaccaacgcgttaatatcgtgcccattctggccaaggctgatactctaactccacctgaagtcgaccataagaaacgcaagatcagggaggaaatcgagcattttggcattaaaatctatcagttccccgattgcgactcagatgaagacgaggactttaagctgcaagatcaagctttgaaggagtcgattccatttgccgtgatcggatcaaacacagtagtggaagctcgcggtaggagggtacgcggtcgtctgtacccatggggaatcgtggaagtggaaaaccctggacattgtgatttcgtaaagttaagaactatgctggttaggacccatatgcaggatctaaaggacgtcacccgcgagacacactatgaaaactaccgagctcagtgtatacagtcaatgacacggctggtcgttaaggaaagaaatagaaataagctcactcgcgagagtgggaccgactttcccatcccagccgttccacctgggactgaccccgagaccgagaagttaatccgtgaaaaggatgaagaattaaggaggatgcaggagatgcttcataaaatccaaaaacagatgaaagagaattattag

SEQ ID NO: 7403 - DNA, 1434 bp, Artificial Sequence
  Description of Artificial Sequence: Synthetic Transcript Sequence
atggacaggagtttgggatggcagggcaacagtgtccccgaagatagaaccgaggccggcattaaacgattcctagaggataccactgatgatggcgaattgtcaaaattcgtcaaggacttttctggaaacgcgtcctgtcaccccccggaggctaaaacctgggccagtaggccgcaggtgccagagccccggcctcaggcgccagacctctacgacgacgatcttgaattccgcccacctagtcggccacagtcatctgacaatcagcagtatttttgtgcacctgctccactttcaccttcggcccggcctaggtcaccttggggcaaactggatccctatgattcaagtgaagacgacaaagaatacgtgggcttcgccacgctgccaaatcaagtccatcgtaagagcgtgaagaagggcttcgattttacactcatggtggccggggaaagtggcctgggaaaatctactctcgttaattctttgtttctgactgacctgtaccgagacagaaaactgctcggggccgaggagaggattatgcagacagtggaaattacaaagcacgcggtggacatagaggaaaagggggtgaggttgcgtttgactatcgtcgatactcctgggttcggcgacgcagtcaataacactgaatgttggaaacccgttgctgaatatattgaccaacagttcgagcagtattttagagacgaatccggactgaacaggaagaacatccaggataacagagtgcattgttgcctctatttcattagtccctttggccatggactgcggcccctagatgttgaattcatgaaagcccttcaccagagggtaaacatcgtgcctattttggctaaagcagacactctaactccaccagaggtcgatcataaaaagaggaagattagagaggagattgagcactttggcatcaagatctaccagttcccagattgcgatagcgatgaagatgaggatttcaagctgcaggatcaggcattgaaagagagtattccttttgcagtgataggttccaacaccgtggtagaggctcgcggaaggcgggtgaggggtaggctgtacccttggggtatagtggaagtcgaaaacccaggccactgcgactttgtcaagctcagaacaatgctggttcgtacccacatgcaggaccttaaagacgtaacgcgggaaactcattacgagaactacagagcgcagtgcatccagtcaatgacaaggctcgtggtcaaagaacgaaacagaaacaaactcactagggagtctggtacggattttccaattcccgcagtgccccccggtacagaccccgaaaccgaaaaactcatccgggagaaggatgaagaactgagacggatgcaggagatgctccacaaaatccagaaacagatgaaagaaaactat

SEQ ID NO: 7404 - DNA, 1434 bp, Artificial Sequence
  Description of Artificial Sequence: Synthetic Transcript Sequence
atggaccggtccttgggctggcaggggaacagcgtgcctgaagaccggaccgaggccgggatcaagaggttcctggaagacactacagacgatggcgagcttagcaagttcgtcaaggacttctcagggaatgcgagttgccaccctcccgaggcaaaaacatgggcttcaaggccccaggtgcctgagcctcgcccacaagcccccgatctgtatgatgacgatcttgagttccggccaccctcaaggccgcagagctcagataaccagcagtacttctgcgcccccgcccccctgagtccctctgctcgtcccagatccccttgggggaagctggacccatacgattcctcagaagacgacaaggaatacgtcggatttgcaactctgcccaaccaggtacatcggaagagtgtcaaaaaagggtttgatttcaccctgatggtcgcaggggaatctggactgggcaaatccacactcgttaattccctcttcctgacggacttgtatagagacagaaagctgctgggcgcagaggaacggatcatgcagaccgttgagatcactaaacacgctgtcgacattgaggagaagggggtaagacttcgtctgactattgtggacactcctggtttcggcgacgccgtaaataatacagagtgctggaagcccgtggcggaatacattgatcaacagtttgagcaatatttccgggacgaatcgggcctcaaccggaaaaatatccaggacaatcgtgtgcactgttgcctgtatttcatctctcctttcggacatggtctgagaccactggatgtagagttcatgaaggctttacaccagagggtaaacatcgtccccatcctggccaaagctgacactcttacgcctcctgaagttgaccacaagaagcgcaaaattagagaagagatcgagcattttggtattaagatttatcagttccctgattgcgatagtgacgaggatgaagatttcaagttgcaggaccaggccctaaaggaaagtatacccttcgcagtcattgggtctaacacagtcgtagaggccaggggaagaagagtccggggacgcctttacccctgggggatcgtcgaagtagagaaccctggacactgcgattttgtaaagctgaggacaatgctagttcgcacccacatgcaggacctgaaagatgtcaccagagagacccactacgagaattatcgggcccagtgcatccagtccatgactcgacttgtagtgaaggaaaggaacaggaacaagctgacacgagaaagtggaaccgattttcctatccccgccgttccacccggtacagatcctgaaacagaaaagcttattcgcgaaaaagacgaggagctcagacgtatgcaggagatgctgcacaagattcagaagcagatgaaggagaattac

SEQ ID NO: 7405 - DNA, 1434 bp, Artificial Sequence
  Description of Artificial Sequence: Synthetic Transcript Sequence
atggaccgaagcctgggctggcagggcaactccgtgcccgaagacagaacagaagcaggaattaaaagattcctagaggacactactgatgacggggaactctcgaagtttgtgaaggactttagcgggaacgctagttgtcatccacctgaagcaaagacctgggcctccagaccacaagtgcctgagccccggcctcaggcgcctgatttatatgatgatgatcttgagtttaggcctcctagtcgccctcagtcttctgacaaccaacagtatttctgcgcccccgcacccctgagtcccagtgctagaccccgatccccatggggaaagctggatccatatgacagtagtgaggacgataaggagtacgtcggtttcgctacgcttcccaatcaggtgcaccgcaagagcgtaaagaagggcttcgactttacactaatggttgccggggaaagcggtctagggaaatccaccctagtgaactctcttttcctaaccgatctgtaccgggacagaaagctgctcggagccgaggaacgtattatgcagaccgtggagatcacaaaacacgccgtggacatagaagaaaaaggcgtgcggctccggctgacaattgtcgacacaccggggttcggcgatgctgtgaataacactgagtgctggaagcccgtcgccgagtacatcgaccagcaattcgaacagtacttcagggatgaaagcgggctcaaccgcaaaaacattcaggataaccgggtgcactgttgcctctactttatctcaccgttcggtcatgggctgagacccttggacgtcgagtttatgaaggctctacaccagcgggtcaacatcgtgcccatcttggcaaaggccgatacgcttaccccccccgaggtggatcacaaaaaaagaaagattcgagaggagattgaacattttggaatcaagatttatcagttccccgattgtgacagcgatgaggacgaagacttcaaactccaagaccaagccttaaaggagagcattcccttcgccgtgattggcagcaacacggtggtggaagccaggggaagacgcgttaggggcaggctatacccttggggtatagtggaggtcgaaaatccaggccactgcgatttcgtcaagcttcggaccatgctagtccgcacccatatgcaagacctcaaggacgtgactagagaaacgcactacgagaattaccgcgcccagtgcattcagtcgatgacaaggctggtggtgaaggaaaggaacaggaataaactcacacgagagtcaggtacagactttccaattcccgcagtgccaccagggaccgaccccgaaactgagaagctgatccgtgaaaaggacgaggagctgaggcggatgcaagagatgcttcacaaaatccagaagcaaatgaaagaaaactat

SEQ ID NO: 7406 - DNA, 1434 bp, Artificial Sequence
  Description of Artificial Sequence: Synthetic Transcript Sequence
atggatcggtcgctggggtggcagggcaactcggtgcctgaggatagaaccgaagcaggaattaagagattcctcgaagatactaccgatgatggcgaactgtcaaaattcgtgaaggacttttcgggtaacgctagctgtcaccctccggaagcaaaaacctgggcctcgcgtcctcaagtgcctgaaccaagaccccaggcacccgatctctacgatgatgatcttgagttcagacctcctagccgtccacaatcgtccgataaccagcagtacttttgtgcaccagccccgctctccccttccgccagacctcgttcaccttggggaaaacttgatccatacgattccagcgaagatgacaaggaatacgtgggctttgcaactctgcctaaccaggtgcaccggaagtccgtcaagaagggttttgattttaccctgatggtggcaggtgaaagcggacttggaaagagcactctcgtcaactcgctctttctcaccgacctgtaccgtgatagaaaattgctgggcgccgaggagcgcatcatgcaaaccgtggagattaccaagcatgcagtcgatatcgaggaaaagggagtgcggttgcggcttactatcgtcgacacccctggattcggcgacgctgtgaacaacacggagtgctggaagccagtggccgagtacatcgaccagcagtttgaacagtactttcgtgatgaatcagggctcaatcgtaagaacatacaagataatagggtgcattgttgtttgtactttatctcgccctttggtcatggattgcgacctttggatgtggaattcatgaaagcacttcaccagcgtgttaacatagtcccaatcctggcgaaggccgatacccttaccccaccagaagttgaccataagaagcgcaaaattcgggaagagattgaacatttcggaattaagatttaccaatttccggattgtgattctgatgaagatgaggactttaagctgcaggatcaagcactcaaggaatcgatcccatttgcagtcatcggatccaacactgtcgtggaagcaagaggtcgacgcgtgagaggacgcctttacccatgggggattgtcgaggtggaaaacccagggcattgtgactttgtcaagctcagaaccatgcttgtccggacccacatgcaggatctgaaggacgtgaccagagagactcattacgaaaactaccgagcccaatgcattcagtccatgactcgcttggtcgtgaaggagcgtaacaggaataaacttactagggaatcagggaccgactttcctattcctgcagtgcccccaggaaccgatccagaaaccgagaagttgattcgggagaaagatgaggaactgcgccgaatgcaagagatgctgcataagatacagaagcagatgaaagaaaactac

SEQ ID NO: 7407 - DNA, 1434 bp, Artificial Sequence
  Description of Artificial Sequence: Synthetic Transcript Sequence
atggatagatccctgggatggcagggcaactccgttcctgaagacaggaccgaggcgggtataaagaggttcctggaggatacgacagatgacggggaactgtccaaatttgtaaaagacttcagcggtaatgctagttgccatccaccagaggcgaagacctgggccagccgcccacaagttccagaaccccggccacaggctcctgatctgtatgacgatgacctggagttccgccccccgtcccgtcctcagagttccgacaaccagcagtacttttgcgccccagcacctctttccccatccgcccgccctagatctccgtggggtaagctcgatccttacgatagttcagaggacgacaaagaatatgtgggctttgctacgctgcctaatcaagtccataggaagtctgtcaagaagggctttgacttcactttaatggtggccggtgaatctggtctagggaagtccaccttagttaatagcttattcttaaccgacctgtatcgagaccgtaaactcctgggggctgaagagcgcatcatgcaaactgtagagataaccaagcatgctgttgacattgaagagaaaggggtaaggctgcggcttaccatagtagacactccaggcttcggggacgctgttaataatactgaatgctggaagcccgtggcggaatacatagaccagcagtttgagcaatattttcgggacgaaagcggactgaacaggaagaacatccaagacaatagagtccattgctgtctgtattttatcagcccctttggccacggactgaggccgctcgacgtggagtttatgaaggccttacaccagcgagtaaacatcgtgccgatcctcgccaaagccgacacattgactcctcctgaggtagaccacaaaaaacgaaaaattcgtgaagaaattgagcacttcggaatcaaaatttaccagtttcccgactgtgatagcgacgaggacgaggactttaagctacaggaccaggcgcttaaggagagcatcccttttgcagtaatagggagtaatactgtggtggaagcaagaggacgcagggttagagggagactctatccatggggcattgtcgaggtggagaatcccggacattgtgactttgtgaaacttcggacaatgctggttagaactcatatgcaggatctgaaggacgtaaccagagaaactcactatgagaactaccgcgctcagtgcatccagtcaatgacccggctggtggtaaaggagcggaaccggaacaaactgacccgggagtcagggaccgactttccgattcctgcagtcccacctgggaccgatcctgaaaccgaaaagctgatccgcgaaaaggatgaggagttgaggaggatgcaggagatgctgcacaaaatacagaaacagatgaaggagaattac

SEQ ID NO: 7408 - DNA, 1434 bp, Artificial Sequence
  Description of Artificial Sequence: Synthetic Transcript Sequence
atggaccggtctcttggatggcagggaaactctgtgccggaggatcgaacggaggcgggcattaaaaggttcctcgaagacactacagatgacggagaattgtctaaatttgtgaaggatttcagcgggaatgcttcgtgccacccgccggaggctaaaacatgggcgagtcgccctcaggtccctgaacccagacctcaggcccctgatctctatgatgacgacctcgaattcagacccccttcacgcccacagtctagcgacaatcaacagtacttttgtgctcccgccccacttagcccgagtgctagacctcgatcaccatgggggaaacttgacccatatgactcctccgaggacgataaagagtacgtcggcttcgctacactgcctaatcaggttcatcgaaagtctgtgaaaaagggctttgatttcactttgatggttgccggcgaatctgggctcggcaagtccacactggttaattcgctgtttctcacagacctgtatagggaccggaagttgcttggcgccgaagaaagaataatgcagacagttgagattaccaagcatgcagtggatatagaagaaaaaggtgtccggctccggctcacgattgttgacactcccggttttggcgatgcagtgaacaatactgaatgttggaaaccagtcgccgagtacattgatcagcagttcgaacagtatttcagagatgaatcaggccttaataggaagaatattcaggataacagggtccattgttgcctctactttattagcccgttcggccacggcttaagacccctggatgtcgaatttatgaaagccctgcatcagcgtgtgaatatagtaccaatactcgcgaaggcagatacactgactccccccgaggttgaccataagaaacgcaaaatccgggaagagatcgagcacttcggaattaagatctatcagtttccggactgcgactccgacgaggatgaagacttcaagctccaggatcaagccctcaaggaaagtataccttttgccgttatcggctctaacactgtcgttgaagcccgcggccgccgggtgcgtgggcggctgtacccttggggaatcgtggaggtggagaaccccggacactgcgactttgttaagctcaggacaatgttggtgcgaactcacatgcaggacctcaaggacgtgacgagagagacccattacgaaaattatcgggctcagtgtatacagagcatgactagactcgtggtgaaggagcggaatcggaacaagttaacccgggaaagcgggaccgatttccccatcccagcggtgcctcccggaactgatcctgagacagagaaactgattcgtgagaaggacgaggaactcaggaggatgcaggagatgctgcacaaaattcagaagcagatgaaagagaattat

SEQ ID NO: 7409 - DNA, 1434 bp, Artificial Sequence
  Description of Artificial Sequence: Synthetic Transcript Sequence
atggaccgatccctgggatggcagggaaatagcgtgcccgaggaccggactgaggccggaatcaagcgctttcttgaggacacaacagacgatggcgagttgagcaagttcgtcaaggacttttctggaaatgcaagttgtcaccccccggaggctaaaacttgggccagcagaccacaggtgcctgagccccgaccccaggcccccgatctctacgacgacgacttggagttcaggcctcctagccgcccccagtcgagcgacaatcagcaatacttctgcgccccagcccctctgagcccatccgctcgaccacgttccccctggggaaagctggacccttatgactcctcggaagatgacaaggaatatgtgggcttcgctaccctgccaaatcaggtgcataggaagtccgtgaaaaagggattcgatttcacactgatggtggcaggagagagtggccttggcaagtccaccctcgtgaattccctgtttttgaccgacctttatagagaccgcaagctactgggcgcagaagaaaggattatgcagacagtggaaattaccaagcacgcggtcgacatcgaggagaaaggcgtacgtctgagactcacaattgtggacacccctggtttcggcgacgccgtgaacaacacggagtgttggaagccggttgccgagtatatagaccagcagtttgagcaatatttccgagacgaaagtggactaaatcgaaagaacattcaagacaaccgtgttcattgctgtttatatttcatatccccattcgggcatgggctgcgcccccttgatgttgagtttatgaaggcccttcatcagcgagttaacatagtccccatactggcgaaagcggacactctgactccacccgaggtggatcataagaaaaggaagatcagggaagagattgaacacttcggtataaagatttatcagtttcccgattgtgacagcgacgaggatgaagactttaagttgcaggatcaagctctgaaagaaagtatccctttcgcggtcattggaagcaacacagttgtagaagctagaggaagaagagtccgagggagactctatccttggggaatcgtggaggtggagaatcccggccactgtgattttgtgaaactccgaactatgttggtacggactcacatgcaggacctgaaggacgtcacaagagaaactcactacgaaaactatagagcgcagtgcattcaaagcatgactaggctagtggtgaaagaaagaaaccgaaacaaacttacgagggagagcggtacagattttcccatccctgcagtgcctccaggaacggaccccgagaccgagaaacttatccgagagaaagacgaggaactgaggagaatgcaagagatgctccacaagatccagaagcagatgaaagaaaactac

SEQ ID NO: 7410 - DNA, 1434 bp, Artificial Sequence
  Description of Artificial Sequence: Synthetic Transcript Sequence
atggaccgctcgctgggttggcagggaaactcggtgcctgaggatcgtactgaggccggcatcaagcgctttctggaggataccactgacgacggtgaactgagcaaatttgtgaaagatttttcaggcaatgctagttgtcatccgcccgaagccaagacctgggcgagcagaccgcaagtgccagagccgcgccctcaggcccctgacctttacgacgacgacctggagtttcgcccaccgtctaggccacagtcaagtgataatcagcagtacttttgtgcgccagctccactctcgccgagtgcgcgcccgcggtccccgtggggaaaactggatccgtacgactcctcggaagatgacaaggaatacgtggggttcgctactctgccaaaccaagtgcacaggaaatcagtcaagaaggggttcgacttcacgctcatggtggcgggggaatctggactgggcaagtcgaccctcgttaattccctgttcctgaccgacctctatagagatcggaaactgctgggcgctgaggagagaatcatgcagactgtggaaatcactaaacacgcagtggacatcgaggagaagggagtgcggctccgcctgaccattgtggatacccccggcttcggggacgccgtgaacaacactgaatgctggaagccggtcgcggaatacatcgaccagcagttcgaacagtacttccgggacgaaagcggattgaatcgaaagaacatccaagataaccgagtgcactgctgcctgtacttcattagccctttcggacacggactgcggccgcttgatgttgaattcatgaaggccttgcaccagcgcgtgaatatcgtcccgattctggcaaaggcagataccttgactccccccgaggtcgaccataagaagagaaagatcagggaagagatcgagcatttcggtatcaaaatctaccagttcccggattgcgattccgatgaggacgaggacttcaaactgcaggaccaagcccttaaggagtcgataccatttgccgtaatcggttcgaacaccgttgtggaagcacgcggaaggcgcgtccggggacggttgtatccttggggcatcgtggaggtcgagaatcctggacattgcgacttcgtgaagttgaggaccatgctggtccgcacgcacatgcaagatcttaaagacgtgacccgcgaaactcactacgagaactaccgcgcgcagtgcatccaatcgatgactaggctggttgttaaggaacggaaccgcaataaacttactagggaaagcggaacggacttccctatccccgccgtgcctccgggaactgatccggaaaccgaaaagctgattcgggaaaaggacgaggaactcagaagaatgcaagaaatgctgcataagatccaaaagcagatgaaggagaactac

SEQ ID NO: 7411 - DNA, 1434 bp, Artificial Sequence
  Description of Artificial Sequence: Synthetic Transcript Sequence
atggatcggagtctgggatggcaggggaattctgtccctgaagatcgcacggaagccggtattaagaggttcctagaggacacgacggatgatggcgaactgtctaagttcgtcaaagattttagcggcaatgcttcttgccatcctcccgaagcaaaaacatgggcgtcacggccgcaagttccagaacctagaccgcaagcacctgacctttacgatgacgatctcgaatttcggccgccgtctagaccgcagtcatccgataaccaacaatatttttgtgcaccggcccctctttcaccttcggctcgtcctcgttccccgtggggaaagctggatccctatgacagctccgaagatgataaagaatacgtcggatttgccaccttgccaaaccaagtgcataggaaatccgtgaaaaaaggttttgacttcacgctgatggttgcaggagagtcaggtcttggaaaatccacgctggtaaatagtttgtttttaacggacctgtatagggatcgcaagttattaggcgcggaggagcgtatcatgcaaacggtcgaaatcacaaagcatgcggtcgatatcgaagaaaaaggcgtcagactgcgcttaactattgttgatacacctggctttggcgatgcggtcaacaacaccgagtgttggaaacctgtggctgaatatattgatcagcaattcgaacaatatttccgggacgaatctgggctaaaccgtaaaaatatacaggataatcgagtgcattgttgcttatactttatttcaccgtttggacacggtttacggcctttagatgttgaatttatgaaagcgcttcatcaacgggtgaatattgtgcctattttagcgaaagccgatacgctgacaccgccagaggttgatcataaaaagagaaaaatcagggaagaaatagaacacttcggaatcaaaatttaccaattcccggattgcgattcagatgaggacgaggatttcaaactacaggatcaggcgctcaaggaatcgatcccgtttgcagtaatcgggagtaacactgtggtagaagcacgggggagacgcgttagagggagattatacccttggggtattgttgaagtagagaatccaggacactgcgattttgtcaaattgcggacgatgctggtccgtactcatatgcaggatctgaaagacgtaacccgtgaaactcactacgaaaattatcgtgcccagtgtattcagagtatgacacggctggtagtcaaagagagaaacagaaataaattgacgagagaatctggcacggattttcctattccggccgtacctccgggtactgaccctgagactgagaagttgatccgggaaaaagatgaagagttgcggcgcatgcaggaaatgctgcataagattcaaaagcagatgaaagaaaattat

SEQ ID NO: 7412 - DNA, 1434 bp, Artificial Sequence
  Description of Artificial Sequence: Synthetic Transcript Sequence
atggaccggagcctcgggtggcagggaaactcagtgcccgaagacaggacggaggcaggcatcaagagatttctcgaggacactacagatgatggagagctttctaagtttgtaaaagactttagtggtaatgcatcctgccacccacctgaagctaagacttgggccagtcgtcctcaggtacccgaaccaaggccccaggcacctgatctttacgacgacgacctggaattccgaccaccgtcccgtcctcaaagctctgacaaccagcagtacttttgcgcccctgcacccctgtctcctagtgccagaccacggtcaccctggggcaagctagatccttatgacagttccgaagatgacaaggagtacgtgggtttcgccacgttgccgaatcaagtccacaggaaatctgtcaagaaggggtttgatttcacattgatggtggccggcgagtccggactggggaagagcactctcgtgaattcactgttcttgaccgacctgtatagggacagaaagctcctaggagccgaagaaagaattatgcagactgtcgaaatcaccaaacatgccgttgatattgaagaaaagggtgtgcggctgcgtctgacaattgtcgatacgcctggctttggagacgctgtgaacaacacggaatgctggaagcccgttgccgagtatatcgatcagcagttcgagcaatactttcgtgacgagtctggcctgaatcgaaagaatattcaggacaatagagtgcattgttgcttatactttatcagcccatttggtcacggccttcgccctttggacgtggagttcatgaaggctctccaccagagagtcaatattgtacccatcttggccaaagcagatacactgactcctcctgaagtcgatcacaaaaaacgaaagatcagggaagaaatcgaacacttcggaattaagatctaccaattcccagattgcgattctgatgaggacgaggattttaaattacaggatcaggccctgaaggagagtattcctttcgctgtgatcgggtccaatacagtggtggaggcgagaggtcgtcgagtcagggggcgtttgtatccctggggaatcgtggaggtggagaaccctggtcactgcgactttgtgaagctgaggacaatgctggtgcgtactcacatgcaggatttgaaggatgttactagggagacgcactatgagaattaccgcgctcagtgcattcagtctatgacgagactggtggtaaaggagaggaaccgcaacaagctgacgcgcgaaagtggaacagacttccctatccccgctgtgcccccgggcaccgaccctgagaccgaaaagcttattcgcgaaaaggacgaagaactccgtaggatgcaggagatgttgcataaaatccaaaagcaaatgaaagagaattat

SEQ ID NO: 7413 - DNA, 1434 bp, Artificial Sequence
  Description of Artificial Sequence: Synthetic Transcript Sequence
atggacaggagcctgggctggcagggaaattctgttcccgaagaccggactgaagctggaattaagcggtttttggaagataccaccgatgatggggagttaagtaaatttgtgaaggacttctccggcaacgccagttgtcacccacctgaagctaaaacatgggcaagtcgccctcaggtcccagaaccccgaccacaggcccctgacctctacgatgacgatcttgagttccggccaccaagtcggccccagtctagcgacaaccaacaatacttttgtgcacccgctcctctcagccccagcgcaagaccacgcagtccttggggcaaactcgacccttacgatagctctgaagacgacaaagaatatgtgggcttcgccactcttcccaatcaggttcaccgaaaatcagtcaagaagggcttcgacttcaccctgatggtggctggggagtccggcctcggaaagagcacactggttaatagcctgtttctcaccgatctgtaccgagatagaaaactgctgggcgcagaagaaagaattatgcagactgtggaaatcacaaaacatgccgtggacatagaggaaaagggtgtcaggctgcgactgacaatagttgacacaccaggatttggtgatgcagttaataatactgagtgctggaagccagtcgcagaatatattgatcagcaattcgaacagtacttcagagacgaaagcggcttaaacagaaagaatatacaggataaccgggtgcattgttgcttatacttcataagcccctttgggcatggtttgaggccactggacgtggaattcatgaaggctctccatcagcgggtgaacatagtgcccatactggccaaggcagacactctgaccccccccgaggtggatcataagaaacgcaaaatccgtgaagagatcgaacacttcgggatcaaaatttatcagttccctgactgtgattccgacgaggacgaagattttaagctacaagatcaggcactaaaggagagtattccattcgctgtcattggatctaatactgtggtggaagcaagaggccgaagagtgcgcgggaggctctacccctggggtatcgttgaggtagaaaacccagggcattgtgactttgtcaagctccgcacaatgctcgtgcggacccacatgcaggatctcaaagatgtgacccgcgaaacacactacgagaactaccgggcacagtgtattcagtccatgacacgtctggtggtgaaggaacggaatcgaaataagctgacccgggaaagtggcactgatttcccaattcccgctgttccacctggcactgatccagagacagaaaaactgatacgcgagaaagacgaggaactgcggcgcatgcaagaaatgttgcataaaattcagaaacaaatgaaagaaaactat

SEQ ID NO: 7414 - DNA, 1434 bp, Artificial Sequence
  Description of Artificial Sequence: Synthetic Transcript Sequence
atggatagaagcctgggatggcaaggaaactccgtgccggaagatcggacggaagctggcatcaagcgctttttggaggataccactgacgacggcgagctgtcgaaattcgtgaaggactttagcggaaatgcatcatgccatcctccggaggccaagacttgggcatcacgtccgcaagtgccggaaccacgccctcaggccccggatctttacgatgatgacctcgagttccgcccaccgagccggccacagagcagtgataatcagcagtatttctgcgctccagcgccactgtcaccatccgcgcgcccccgctcaccttggggcaagctcgatccctacgattcgtccgaggacgacaaagaatacgtgggtttcgcgactttgccaaaccaagtccacaggaagtccgtcaaaaagggattcgatttcacccttatggtggcaggggagtcgggcctcgggaaatcaactctcgttaattccctcttcctgaccgacctctaccgcgacagaaagctcctgggggcggaggagcgtatcatgcagacggtggaaattaccaagcacgccgtcgacattgaagaaaagggtgttcgcctgcgattgaccattgtggacacgccgggctttggagacgccgttaacaataccgaatgctggaagcctgtcgcggagtacatcgatcaacagtttgaacaatacttcagagacgaatcgggcctcaaccgcaagaacatccaggacaatagagtgcactgctgcctgtacttcatctccccgttcggacatggactccgaccgctggatgtagagttcatgaaagcactgcaccagagagtgaatatagtgccgatcctggccaaagctgacactctgactcctcccgaagtggaccacaaaaagagaaaaatccgcgaagagatcgagcattttggaataaagatctatcaattccctgactgcgactctgatgaagatgaggatttcaagctgcaggaccaggcccttaaagaatcaatccccttcgcagtcattggcagcaacaccgtagtggaagcccggggacgcagagtgaggggaagattgtacccgtgggggatcgtggaggttgagaacccaggacactgtgactttgtgaagctccgcactatgctggttagaactcatatgcaagacctcaaggatgtcacccgagaaacccattacgaaaactaccgagcccagtgtatccaatctatgaccagactggtcgtgaaagaacgcaatcggaacaagctgacccgggagtccggcaccgacttcccaatccccgcggtccccccgggtaccgacccggagactgagaagctgatccgggaaaaggacgaggagctgaggcgtatgcaggaaatgctccacaagatccagaagcaaatgaaggaaaactac

SEQ ID NO: 7415 - DNA, 1434 bp, Artificial Sequence
  Description of Artificial Sequence: Synthetic Transcript Sequence
atggaccgatccttgggttggcaaggaaacagcgtgcctgaagaccgaaccgaagctggaataaagcggtttctggaagatacgacagacgatggcgaactgtccaagtttgtgaaggacttctcaggtaacgctagttgccacccccccgaggcaaaaacctgggcatccagacctcaagttccggagcctaggcctcaggcccctgacctgtatgacgatgacctggagtttaggcccccaagcaggccccaatcctctgacaatcaacagtatttttgtgcccccgcccctttgagcccatcggcccgacctcgcagcccctgggggaagctggacccgtacgacagctcagaagatgataaagagtacgttgggttcgctaccttacctaaccaggtccatcgcaagtccgtcaaaaagggctttgattttacactcatggtggctggagagagcggcctggggaaaagtaccctggtgaatagcttgtttctgactgatctatatagggaccgtaagctgctgggagccgaggaacggattatgcagactgtcgagataacaaagcatgccgttgatattgaagagaagggggttaggctgcgtctaacgatagtggacaccccaggatttggagacgcggtgaacaataccgaatgctggaagcctgttgcagagtatatcgatcagcagttcgaacaatatttcagagacgaaagcggattaaacaggaagaatatacaggacaacagggtccactgctgcctttatttcatcagtccattcggtcatgggttgcggccactcgacgtggaatttatgaaggcgctgcaccaacgcgtgaatatcgttcctatcttggcgaaggctgacacgctgacccctcccgaagtggatcacaagaagcgcaagatcagggaagaaattgagcatttcggaattaaaatctaccagttccccgactgtgactcagatgaggatgaggactttaagctccaggaccaggcgcttaaagaaagcatcccctttgccgtaatcgggtccaacacagtcgtggaggcgaggggaagaagagtgagggggagactgtacccgtggggtatcgtggaagtagagaaccctgggcactgtgactttgtaaaactgcgtaccatgctcgttaggacgcacatgcaagatctgaaagacgtgaccagggagactcattacgaaaattacagggcccagtgtatccagtctatgacacgcttagtcgtgaaggaaaggaataggaacaagttgacgcgggaatcaggtactgatttccccatacccgccgtcccccccggaacagaccccgagaccgagaagctaatcagggaaaaagacgaagagctccgccgcatgcaggagatgctgcataagattcaaaaacaaatgaaagaaaactac

SEQ ID NO: 7416 - DNA, 1434 bp, Artificial Sequence
  Description of Artificial Sequence: Synthetic Transcript Sequence
atggatcggtcgctgggttggcagggaaacagcgtccccgaagatcggaccgaagcaggtatcaagcgcttcctggaggacaccacggatgacggcgaattgtccaaatttgtgaaagacttctccggaaacgcctcctgccaccctccggaggccaagacttgggcttcaagacctcaagtgcctgaaccgaggccacaagcgcccgacctctacgatgacgatctggagtttcggccgccaagccgcccgcaatcatcggataaccaacaatacttctgcgcgccggctcctctgtcgccgagcgcccggcctaggtcaccgtggggaaagctggacccatatgattcgtcggaggacgacaaggagtacgtgggattcgccaccctgcccaaccaggtgcacagaaagtcagtcaagaagggtttcgacttcaccttgatggtggcgggcgaatcaggactgggcaagtccaccctcgtcaattcgctgttcctgactgatctctaccgcgatcgcaaattgttgggcgcggaggaacggatcatgcagactgtggagattaccaaacatgccgtggacatcgaggagaaaggagtgcggctgcggctgaccatcgtggatacccctggtttcggtgacgcggtgaacaatactgagtgttggaagcccgtggcagagtacatcgaccaacagtttgagcagtacttcagagacgaatcgggcctcaacaggaagaatattcaggataatcgcgtgcattgctgtctgtacttcatctccccgttcggacacggtctgaggcctctggatgtggaattcatgaaggcacttcaccagagagtcaatatcgtgccaatcctcgctaaggccgacactctgacgcccccagaagtcgaccacaagaagcgcaagatccgggaagaaatagagcatttcggaatcaagatttatcaatttccggactgcgattcagacgaggatgaagatttcaagctgcaggatcaagccttgaaggagtccattcctttcgcagtgatcgggagcaatacggtcgtggaagccaggggacgccgggtgagaggacggctgtacccgtggggaatcgtcgaagtggagaaccctggccattgcgacttcgtgaagctgagaactatgctcgtccgcacccacatgcaggacttgaaggacgtcactcgcgagacgcactacgaaaactaccgggctcagtgcatccagagcatgactcgcctggtggtgaaggagcgcaaccgcaacaagctcacccgcgaatccggcacggactttccgatcccggcggtcccaccgggaacggatccggaaaccgaaaagctgatcagagagaaggacgaggagctgcggagaatgcaggaaatgctgcacaagatccagaagcagatgaaggagaactac

SEQ ID NO: 7417 - DNA, 1434 bp, Artificial Sequence
  Description of Artificial Sequence: Synthetic Transcript Sequence
atggacaggtcactcggttggcagggcaactccgtcccggaggatcgcacggaagccggtatcaagcgcttcctggaagataccaccgacgacggagaactttcaaagttcgtgaaagatttctcgggcaacgccagctgccacccacctgaagcaaagacttgggcctcccgcccacaagtgccggaaccgcgccctcaggcccctgacctgtacgacgacgatttggaattccggccgccgagccggccgcagagttcggacaaccaacagtacttttgtgcaccggcccctctgtcgccgtccgcacggccgagaagcccgtggggaaaactggacccgtacgactcatcggaagatgataaggaatacgtgggtttcgcaactctccctaatcaggtccaccggaaaagcgtgaagaagggattcgacttcaccctcatggtggcaggcgaatccggtcttggaaagtcaactctggtgaactcgctgtttctgacggatttgtacagggaccgcaagctgctgggcgcggaggagcggatcatgcagaccgtggagattaccaagcatgctgtcgatatcgaagagaaaggagtgagactgcggctgaccatcgtggatacgccaggctttggtgacgcggttaacaatactgaatgctggaagccagtggccgaatacatcgatcagcagttcgagcagtacttccgggacgagtcaggcctgaatcggaagaacattcaagacaaccgagtgcactgctgcctctacttcatctcaccctttgggcatggactcagaccgctggacgtggagttcatgaaagcattgcatcagagagtcaatatcgtgcccatcctcgcgaaagccgacactctgactcctccggaagtggatcacaaaaagcggaaaattcgggaagaaattgagcacttcggtatcaaaatctaccagttccctgattgcgactctgatgaggacgaggacttcaagctccaagatcaagcgctcaaggaatcgatcccgtttgctgttatcggttcgaacaccgttgtggaagcacgcggccggcgcgtcagaggacggctgtacccatggggcatcgtcgaggtcgagaacccaggacactgcgacttcgtgaagttgcgcactatgctggtgcggacccacatgcaggacctcaaggacgtcaccagggaaactcactacgagaattaccgcgcccagtgcatccaatcaatgacccggctggtcgtgaaagagcggaaccggaacaaactgaccagggagagcgggacggactttcctatccctgccgttccacctggtaccgatccagaaacggaaaaactcattcgggagaaggacgaagagctgcggagaatgcaggaaatgctgcacaagatccaaaagcagatgaaggagaactac

SEQ ID NO: 7418 - DNA, 1434 bp, Artificial Sequence
  Description of Artificial Sequence: Synthetic Transcript Sequence
atggatcggagcctgggatggcaaggtaactcggtccccgaggatagaactgaagcgggaatcaagcgttttctggaagatacgactgacgatggtgaactgtccaaattcgttaaggatttttcgggaaatgcgtcgtgtcatcccccagaagctaagacctgggctagccggccccaggtgccagaaccgcgtccacaagcaccagatctttacgatgacgatcttgagtttagacctccttcccgccctcaatcatccgataatcagcagtacttttgcgcacctgctccactttcaccatccgcccgccctaggtcgccctggggtaaacttgatccatacgacagctccgaggacgataaagagtacgtcggatttgctaccctgccgaaccaggtccatcgaaagtctgtgaagaagggatttgattttaccctcatggtggccggagaatcaggccttgggaagtccaccttggtgaattccctctttttgacggacttgtacagagatagaaaactcctgggtgccgaagaaagaattatgcaaaccgtcgaaattaccaagcacgcagtggatatcgaggaaaaaggagtccgcctgcgtcttactatagtcgacactcctggatttggtgatgcagtcaacaataccgaatgttggaagcccgtcgccgagtacattgaccagcaattcgagcaatactttcgagatgaatcaggtcttaacaggaagaatattcaagataaccgagtgcattgttgcttgtacttcatctccccttttgggcacggacttcgccccctcgatgtggaattcatgaaggcactgcatcagcgggtgaacatcgtgccgatcctcgcaaaggcagatactcttactccacctgaagtcgatcacaaaaagagaaagatacgtgaagagattgagcattttggaatcaagatataccagtttcctgactgcgacagcgacgaggatgaagatttcaagctgcaggatcaggcgcttaaagagtccatacccttcgcagtgattggatcaaacaccgtggtcgaagcaagaggccgtcgggtgagaggtcgcctctatccctggggcattgtggaggtcgaaaaccccggtcattgtgactttgtgaagctcaggactatgttggtgcgaactcacatgcaggatctcaaggatgtgactagagaaacccattatgagaactaccgggcacaatgtatccagtcaatgactagactcgtcgttaaagaaaggaatcggaataagctgacgcgagagagcggcactgatttcccaattcccgcagtgcctcctggaactgatcctgaaactgagaaactcattcgggaaaaggatgaagaacttcgtcggatgcaggaaatgttgcataagatccaaaagcagatgaaagagaactac

SEQ ID NO: 7419 - DNA, 1434 bp, Artificial Sequence
  Description of Artificial Sequence: Synthetic Transcript Sequence
atggatagatctctgggttggcagggcaacagtgtccccgaggaccgtaccgaggcaggtatcaagcgctttcttgaggacaccaccgatgatggcgagctttccaagttcgtcaaggatttttccggcaacgcctcctgtcaccccccggaagctaagacctgggcctctcgcccccaggtgcccgaaccccgaccgcaagcccccgacctgtacgatgacgatcttgagttccgcccgccatcccgtccgcagtcttcggacaaccagcagtatttctgcgcgccggcccccttgtctccctcggcccgcccacgttcgccgtggggaaagttggatccttacgatagctccgaggacgataaggaatacgtcggtttcgcgactcttccgaaccaggtccacaggaaatccgtcaagaagggtttcgatttcaccctgatggtggccggcgaatccggactcggcaagagtacgctggttaacagccttttcctgacggatttgtaccgggaccgcaagctgctgggcgcggaggagcgaatcatgcaaaccgtcgaaataacgaagcatgctgttgatatcgaagagaagggtgtccgtttgaggctgaccatagtggatacaccgggttttggtgacgccgtgaacaataccgagtgttggaagcctgttgccgagtacatagaccagcagtttgaacagtacttccgcgatgaaagtggtctcaaccgaaagaacattcaggacaaccgtgtccactgctgcttgtacttcatcagcccgttcggtcacggtctcaggccccttgatgtagagttcatgaaggctcttcaccagcgcgtgaacatcgtgccgatcctggccaaggccgacactctcactccgccggaagtggaccacaagaagcgcaaaatccgcgaggaaatcgaacacttcggtatcaagatttatcagttcccggattgcgattccgatgaagacgaggactttaagctacaggatcaggcgctcaaagagtctatcccctttgctgttatcggaagcaacaccgtggtggaggctcgtggccggcgagtgcgcggcaggctctacccctggggtatcgtggaggtggagaaccccggccattgcgattttgtcaagctgcgcaccatgctcgtccgtacacatatgcaggacctgaaggacgttacccgcgaaacccattatgaaaactatcgtgcccagtgcattcagtctatgacgcgcttggtggttaaggagagaaaccggaacaagttgacccgggagtctggaacagatttccccatcccagcagtccctcccggtactgaccctgagaccgaaaagctgatccgtgaaaaggacgaggagctccgccgtatgcaagagatgctccataaaatccagaagcagatgaaggagaactat

SEQ ID NO: 7420 - DNA, 1434 bp, Artificial Sequence
  Description of Artificial Sequence: Synthetic Transcript Sequence
atggacagatctctgggatggcaagggaactcagtgcccgaagatagaacggaggccggtatcaagcgcttcctggaggacaccactgatgacggtgaactcagtaagttcgtgaaggatttttctggcaacgcttcctgccacccgcccgaagctaaaacatgggctagccgaccccaggtacccgagcctcggcctcaggccccggatctgtacgacgacgatctggagtttcgacccccctctaggccacagagttccgacaatcagcagtacttctgtgcccccgcccctttgagcccgagtgcgcgcccacgatccccttggggcaagcttgatccgtatgactcttctgaggatgacaaggagtacgtcggcttcgccacgctgccaaaccaggtgcatcgaaaatcagtgaaaaaaggcttcgacttcaccctcatggtggctggggaaagcgggctgggtaaatcaaccctcgtgaattctctgtttctgactgacctttacagggatcgaaagctgctgggggccgaggagcgaatcatgcagactgtggaaattactaagcacgctgtggatattgaagaaaagggagtacggctgaggctcacaatcgtggacacaccgggcttcggcgacgccgtcaacaacactgagtgctggaaacccgtcgcagaatacattgaccagcagtttgaacaatacttcagagacgaaagcgggcttaataggaagaatatccaggataatcgggttcattgttgcctctactttataagtccgtttggccacgggctcagacctctggacgtagaatttatgaaagcactgcaccagcgcgtcaacatcgttccaatactggcaaaggcggatacacttacaccacccgaggttgaccacaagaagcggaagatacgcgaggagattgaacatttcgggattaagatctaccagttcccagactgtgattccgatgaagatgaggactttaaactgcaggaccaggcgctgaaggagtccatccccttcgcagttatagggtcaaataccgttgtggaggcgcgggggcggagagtcagaggaaggctgtatccatggggcattgtggaagtggaaaaccccggccactgcgacttcgtgaagctccggaccatgttggtcaggacccacatgcaggaccttaaggacgtcacccgggagacgcattatgaaaactaccgcgcgcagtgcattcagtccatgacgcggctcgtggtgaaagagagaaacagaaataaattgacccgagagagtggcactgactttccaatacctgccgttccacctgggactgacccagaaaccgagaaactcattagggagaaagatgaggagttgcgcagaatgcaggagatgcttcataaaatccagaagcagatgaaggagaattat

SEQ ID NO: 7421 - DNA, 1434 bp, Artificial Sequence
  Description of Artificial Sequence: Synthetic Transcript Sequence
atggatagaagcctgggatggcagggaaactccgtccctgaagatagaactgaagccggaatcaaacgcttcctcgaggataccacggacgatggcgagctttccaagtttgtgaaggatttttcgggaaacgcaagctgtcatcctcctgaggcaaagacctgggcctcccggcctcaagtgccagaaccgaggcctcaggcaccagatctgtacgatgatgacctggaatttcggccaccttcgaggccacaatcgtcagataaccaacaatacttttgtgctccagcacctctcagcccctcggcaagacctaggagcccctgggggaagctggacccatacgattcctcggaagatgataaggagtacgtggggtttgcaactttgcctaatcaagtccacaggaagtcggtgaagaaaggatttgattttactcttatggtggcaggagagtcgggactcggcaagagcactcttgtgaattcactgttcctgaccgacttgtacagggatcgcaagctgctgggagcggaagaacggattatgcaaaccgtcgaaatcactaaacatgcagtagacattgaggagaagggcgtgcgacttaggctcactatcgtggacaccccaggatttggagacgcggtgaacaacacggagtgttggaaacctgttgccgaatacattgaccagcagttcgaacaatactttcgagatgaatcaggactcaatcgcaagaacatccaagataaccgagtgcactgctgtctttacttcataagcccttttggccatggactgcgccctctcgatgtggaattcatgaaagcactgcatcaaagagtgaatattgtgcccatccttgcaaaggctgatacccttacccctccagaagtggaccataagaagagaaagattagagaggaaattgaacacttcggaattaagatctaccagttccctgattgtgattcggacgaagatgaggatttcaagctgcaggatcaagccctgaaagaatccatccctttcgcggtgataggatcgaataccgtggtcgaagcccggggaagaagagtgcgggggcggctttatccttggggaatagtggaagtggagaacccgggacattgtgattttgtgaaacttcgcaccatgctggtgagaactcacatgcaggatctgaaggatgtgacccgagaaacccactacgaaaactaccgcgcacaatgcatccagtccatgaccagactggtggtgaaggaaaggaaccgcaataagctcacccgtgagagcgggacggatttcccaattccagcagtcccacctggaaccgaccccgaaaccgagaagctgattagagaaaaggatgaggagctgagaagaatgcaagaaatgctccataagattcaaaaacaaatgaaagaaaactac

SEQ ID NO: 7422 - DNA, 1434 bp, Artificial Sequence
  Description of Artificial Sequence: Synthetic Transcript Sequence
atggatagaagcctcggatggcagggaaacagcgttccggaggacagaactgaggcagggatcaagcgattcctggaggacaccactgatgacggagaattgagcaagttcgtcaaggacttttccggtaacgccagctgccacccgcctgaggccaaaacctgggcctcgcgtccccaggtcccagagcctcgcccacaagcgccggacctctacgatgatgatttggagttccggccgccaagccgcccgcaatcgtccgacaaccagcagtacttttgcgcacccgcccccctgtcaccttcggcacgcccaaggtccccgtggggcaagctggacccatacgactctagtgaagatgataaggaatacgtcggatttgccacccttcctaatcaggtccaccggaaaagcgtgaagaaaggattcgatttcactttgatggtggccggagagagcggtcttggcaagtcgacgttggtgaattctcttttccttaccgacctctaccgggaccgcaagttgctcggagcagaagaacgtatcatgcagactgtggaaatcactaagcacgccgtggacattgaggaaaaaggcgtgcgcctgcggctgaccatcgtcgacactccgggcttcggcgatgcggtgaacaacaccgagtgttggaagccggtggcggaatacatcgatcaacaattcgagcaatactttagggatgagagcggtctgaaccgcaaaaacattcaggacaaccgggtgcattgttgcctgtatttcatcagccctttcggacatggtctgcgcccactggacgtggagttcatgaaagcccttcatcagcgagtcaatatagtcccaattctcgctaaggctgacactctcacgcctccggaggtcgaccacaaaaagcggaagatacgggaggaaatcgaacactttggaataaagatctaccagttcccggactgcgattcagatgaggacgaggactttaagctgcaagaccaggccctcaaagaatcaattccgttcgcggtaatcgggtccaacactgttgtggaggcccgcgggagacgggtgcgcggccgcctgtacccctggggaatcgttgaagtggaaaatccgggacactgcgatttcgtgaagctccggaccatgctcgtgcggactcatatgcaagaccttaaggatgtcacccgagaaacccactatgaaaactaccgggcacagtgcattcagagcatgactcggctcgttgtcaaggagagaaatagaaacaaactgacccgcgaatcggggacggacttccctatccctgctgtgccgccgggaaccgatcccgagacggaaaagctgatccgggaaaaagacgaagagcttcggcggatgcaagagatgttgcacaaaatccagaagcaaatgaaggaaaactac

SEQ ID NO: 7423 - DNA, 1434 bp, Artificial Sequence
  Description of Artificial Sequence: Synthetic Transcript Sequence
atggatcggtcgcttgggtggcaaggaaatagcgtgcctgaagatcggactgaggccggtattaagagatttcttgaagatactactgacgacggagaactctcgaaatttgtgaaggatttttcgggaaacgcaagctgtcatcctcccgaagccaagacgtgggcatcacgccctcaagtgcccgagcctagaccacaggcaccagacctttacgacgacgaccttgagtttcgtccaccttcgcgaccacagtcctctgataaccaacagtacttttgcgcaccagcccctctttcaccatcggcaaggcctcggtcgccctggggaaagctggatccttacgactcgtcggaagatgacaaggaatacgtggggtttgcaacccttcccaaccaagtccatcggaaaagcgtcaagaagggattcgatttcacccttatggtggcaggagaatccggacttggaaagtcgacccttgtgaattcgctctttttgactgacctttaccgggataggaagctcctgggagcggaagagagaatcatgcaaaccgttgagatcactaaacacgcagtcgatatcgaagagaagggagtgagactgcgcctcaccattgtcgatacccctggatttggtgacgcagtgaacaataccgaatgctggaaacctgtggcagaatacatcgatcaacaatttgaacaatacttccgcgatgaaagcggtctgaaccgtaagaacattcaggacaatagagtgcactgttgtctttacttcattagtccttttggtcatggacttcggccactcgatgtcgagtttatgaaggcgctgcatcaaagggtcaacattgtgcctatactggcaaaagccgacactctcaccccacctgaagtcgatcacaaaaaacggaagattcgggaggaaattgaacattttggtatcaagatctaccagttccctgactgtgattctgatgaggatgaagatttcaagctccaagaccaggcactgaaggaatccattcccttcgcagtgattggatcaaacacggtggtggaggctcgtgggcgcagagtgcgcggcagactttatccctggggcatcgtggaagtggagaatccgggtcattgcgactttgtgaagctgcggaccatgctggtgcgaacgcatatgcaggacctcaaagacgtgactagggagactcactacgaaaactacagagcccaatgcattcaatcgatgacgcggcttgtggtgaaggaaagaaaccgcaacaaattgaccagggagtcgggtaccgattttccaatcccagcagtgcctcctggaaccgatcctgagactgaaaagctgattcgggaaaaagatgaggaacttcggcggatgcaagagatgctccacaagatacaaaaacaaatgaaagaaaactat

SEQ ID NO: 7424 - DNA, 1434 bp, Artificial Sequence
  Description of Artificial Sequence: Synthetic Transcript Sequence
atggatagatcgctgggatggcaaggaaacagtgttcctgaggaccgcaccgaagcaggaatcaaacggtttctggaggataccactgatgacggtgagttgtcaaagtttgtgaaagacttcagcggaaatgcatcctgccacccccctgaagcaaagacctgggcttcccgtccacaagtgcccgaacctcggcctcaagctccggatctttacgacgacgatctggaatttcggcctccttcacggccccaaagctcggacaaccaacagtacttctgcgcacccgcaccactgtcaccatccgccagaccaaggagcccctggggtaagctcgacccatacgattcctctgaggatgataaagaatacgtggggtttgccacccttccaaaccaggtccatcgcaagtcggtgaagaaaggctttgatttcaccctcatggtggcaggcgagtcgggactgggtaagtctactctcgtgaatagcctgtttctgactgatctgtacagggatcgtaagctcctcggagcggaagagcgaattatgcagactgtggaaattaccaagcatgcagtcgatattgaagaaaagggtgtgagactgaggctgacgattgtggatactcccggtttcggagatgcggtgaataacaccgaatgttggaagccagtggcggaatacatagatcagcaatttgagcagtatttcagggatgaaagcgggcttaatagaaagaacatccaagacaacagagttcactgttgtctttacttcatcagtccttttggtcatgggctgcgtcctctggatgtcgagtttatgaaagcgctccatcagagagtcaatatagttcccattcttgcaaaggcagacacgctcaccccaccggaggtggatcataagaagagaaagatccgggaggaaatcgagcattttggtatcaagatctaccagtttccagactgtgattccgatgaggacgaggacttcaagctgcaagatcaagctcttaaggaaagcataccgttcgccgtcattggaagtaatacggtcgtggaagcacgcggcagacgagtgcgcggccgcctgtacccttggggcattgtggaagtagagaatccaggacattgcgattttgtgaaactccgcaccatgctcgtcagaacgcatatgcaagatcttaaagacgtgactagggaaactcactacgaaaactaccgcgcccaatgtatacagtctatgactcggctcgtggttaaggagcggaaccggaacaaacttactagagaatcgggtaccgacttccctattcctgccgtgcctccgggaaccgaccccgaaactgaaaaacttattagggaaaaagatgaagaacttaggcgaatgcaggaaatgctccacaagattcagaagcaaatgaaggagaactat

SEQ ID NO: 7425 - DNA, 1434 bp, Artificial Sequence
  Description of Artificial Sequence: Synthetic Transcript Sequence
atggatcgctctttgggctggcagggcaactctgtccctgaagacagaacagaggccggcataaagagattcctggaagataccactgacgatggagagctgagtaagtttgtaaaggactttagcggaaacgcatcatgtcaccctccggaggctaaaacctgggcaagcaggcctcaggtgcctgagccccgcccacaagcacccgatctctatgacgacgaccttgagtttagaccaccatctcgcccgcagagttccgacaaccagcagtatttttgcgctccagcacccctctccccaagcgcacgccctcgctccccatggggaaaactggacccctatgatagctctgaagatgacaaggaatatgttggcttcgccacactcccaaatcaagtgcataggaaatctgtcaagaagggcttcgacttcaccctgatggtagcaggagagagcggcctgggcaagtctacgctcgtgaattctttgttcctgaccgacctctatagggaccgcaaactcttgggtgctgaagagcgcatcatgcagacagtagaaatcactaagcacgctgtcgatatcgaagaaaagggagtaagacttagactgacaattgtcgacacccccggcttcggagatgctgtgaacaatactgaatgttggaagcctgtagctgaatatattgaccagcaatttgagcagtatttcagagacgagtcaggactgaaccgcaagaacatacaggataaccgcgttcactgttgtctctacttcatttcacctttcggccacggactcaggcctttggatgtggagttcatgaaggctctccaccagcgcgtcaatattgtgccgatcctcgccaaggcggacaccctcaccccacccgaagtcgaccataaaaagaggaagatcagggaggagatcgagcattttggcattaagatctatcagttccctgactgtgactcagacgaggatgaggacttcaagttgcaagatcaggcgctcaaggagtccatcccatttgcagttatcggaagcaacactgtagttgaagccaggggcagacgcgtccgcggcaggttgtatccatggggtatagtggaggtcgagaatccgggccattgcgacttcgtgaaacttagaacaatgcttgttaggacccatatgcaagacttgaaggacgtcaccagggaaactcactacgaaaattatagggcccaatgcatccaatccatgactcgcctggttgtcaaggagcgcaaccgcaacaaactgactagagaatctggcacagacttcccaattcccgccgttccgcctggaacagatccagagacagagaagctgatcagggagaaggacgaagagcttagaaggatgcaggagatgctgcacaaaattcagaagcagatgaaggagaactac

SEQ ID NO: 7426 - DNA, 1434 bp, Artificial Sequence
  Description of Artificial Sequence: Synthetic Transcript Sequence
atggatagaagcctcggctggcaaggtaactccgtccctgaggacaggacagaagcaggtatcaaacggtttctcgaagacacaactgacgatggagaattaagcaagttcgtcaaggactttagcggcaatgcctcttgccacccgcctgaggctaagacatgggcatcacggccacaggtgcctgaaccaaggccccaggcccctgacctctatgatgatgacctggagttccggccacctagtaggccacaatcctctgacaaccaacagtacttttgcgcaccagcacctcttagtccaagtgccaggccaaggagcccatgggggaaattagacccttacgacagttctgaagatgataaagagtatgtgggtttcgcaacattgccgaatcaggtgcatcggaagagtgttaagaaaggatttgacttcacattaatggtggcaggggagagcggcctgggaaaaagtactttggttaattcactgttccttactgacctgtatagggatagaaagctgctgggagccgaggagagaatcatgcagaccgtggaaatcacgaaacacgccgttgacatcgaagagaagggcgtgagacttcgcctcacaattgttgatacacctggcttcggcgacgccgtgaacaataccgagtgctggaagcctgtagcagagtacatcgaccaacagttcgaacagtactttcgggatgaatccggcctcaaccggaagaacatacaggacaatagggtgcactgctgcttgtatttcatctccccttttggtcacggtctgcgtcctctggacgttgaattcatgaaggctcttcaccagcgggtgaatatagtgccgattttagctaaggctgatacgctgacgccgcctgaagttgatcacaaaaaaaggaagatccgggaagagattgagcactttgggataaagatctatcagtttcctgattgtgactctgacgaggatgaggacttcaaactgcaggatcaagcactgaaagagtccattccgttcgctgtgattggctcaaatacggtagtggaggctcggggccgtcgagtgcgcggtaggctgtatccttggggaattgttgaagtggaaaaccccgggcattgtgacttcgttaaactgaggaccatgttagtgcgcactcacatgcaagaccttaaagacgtcactcgtgaaacccactacgagaactacagggctcagtgcatacagagtatgacccggctcgtcgtgaaggaacggaaccgcaacaaattgaccagggaaagcggcacagattttcctataccggccgtcccacctggcaccgaccccgaaaccgaaaaacttatcagggagaaagatgaagagctcagaaggatgcaagaaatgctccataaaatccagaagcagatgaaggagaactat

SEQ ID NO: 7427 - DNA, 1434 bp, Artificial Sequence
  Description of Artificial Sequence: Synthetic Transcript Sequence
atggatcgtagtcttggatggcaaggaaatagtgttccagaagatagaactgaagcagggataaaacgtttccttgaagacacaacagatgatggtgaattatctaaatttgttaaagacttttccggtaatgcatcatgtcatcctccagaagctaaaacttgggcctctagaccacaagttcctgaaccaagaccacaagctccagatctttatgatgatgacttagaatttagaccaccatcacgaccacaatcaagtgataatcaacagtatttttgtgcacctgcaccactttcaccaagtgctagacctcgaagtccatggggtaaacttgatccatatgattctagtgaggatgataaagaatatgttggattcgctactttaccaaatcaagtacataggaaaagtgttaaaaaaggatttgatttcacattaatggttgcaggagaatcaggacttggtaagagtactcttgttaatagtttatttcttactgatctttatagagatagaaaattgttaggtgctgaagaaagaattatgcaaacagttgaaataactaaacatgctgttgatattgaagaaaagggtgttagattaagattgacaattgttgatacaccaggatttggagatgcagttaataatactgaatgttggaagcctgttgcagaatatatagatcaacaattcgaacaatattttagagacgaatcaggtttaaacaggaaaaatattcaagataatagagttcattgttgtttatattttatttcaccttttggtcatggacttagaccattagatgttgaatttatgaaggctttacatcaacgtgttaatattgttccaattcttgctaaagctgatactttaactccacctgaagtggatcataagaagagaaaaattagagaagaaatagaacatttcggaattaaaatttatcaatttccagattgtgattcagatgaagatgaagatttcaaattgcaagatcaagcattaaaggaatctattccatttgcagttattggttcaaatactgttgttgaagctagagggagaagagttcgtggaagattgtatccatggggtattgtcgaagtagaaaatccaggacattgcgattttgttaaacttagaactatgttagttagaactcatatgcaagatttaaaagatgttacacgtgaaacacattacgaaaattatagagcacaatgtattcaatctatgactagattagtggtaaaagaaagaaatagaaataaattaacaagagaatcaggaacagattttccaattccagctgttccaccaggaacagatccagagactgaaaagttaattcgtgaaaaagatgaagaacttagaagaatgcaagaaatgttacataaaattcaaaaacagatgaaagaaaattac

SEQ ID NO: 7428 - DNA, 1434 bp, Artificial Sequence
  Description of Artificial Sequence: Synthetic Transcript Sequence
atggaccggtcactgggttggcaaggaaactcggtgccagaagatagaactgaagcagggattaagaggttcttggaagataccaccgacgacggtgaactgtcgaaatttgtgaaggactttagcggaaatgcaagctgtcaccctccagaggcgaaaacgtgggcaagcagacctcaagtgccagaaccccgcccccaagcgcctgacctctacgacgacgatctggaattccgccctccatcccgcccgcagtcatccgataatcaacagtacttttgtgcgccggcgccactttccccctcagcacgtccgcgctcgccctggggtaagctggatccatacgattcgagcgaagatgacaaggaatacgtgggttttgcgacccttcccaaccaggtccaccgcaagagcgtgaagaaagggttcgatttcactctgatggtggcaggcgagtcgggactcgggaaatcgacccttgtgaacagtcttttcctcaccgatctgtacagggatcgcaagctcttgggtgcggaggagaggattatgcaaaccgtcgaaattaccaagcatgcagtcgatattgaagaaaagggagtgaggctgcgacttaccatcgtggatacccctggttttggagatgcggtgaacaacactgaatgctggaagccagtcgctgaatacatagatcagcagtttgagcaatacttccgtgacgaatcagggctgaacaggaagaatatacaggacaacagagtgcactgttgtctctacttcatctccccatttgggcatggactccggccgctggacgtcgaattcatgaaggctcttcaccaacgggtcaacatcgtccctatactggccaaagccgatactctgacccctcctgaagtcgatcacaaaaagcggaagatccgagaggagattgagcatttcggcattaagatttatcagttccccgattgtgatagcgacgaggatgaggactttaagctgcaagatcaggctcttaaggaatccatcccatttgcagtgataggctccaacaccgtggttgaggcccgcggaaggcgagttagaggacgtctctacccatggggtatcgtcgaagtggagaatccgggccactgtgactttgtgaaactgcgcactatgctggtcagaacccatatgcaagacctgaaggacgtcactcgcgaaacccactacgagaactatagggcacagtgtattcaaagcatgacgcggcttgtggtgaaggagcggaatcgtaataagctgacccgggaaagcggaactgattttcctataccagcagtgcccccaggaaccgacccggaaaccgaaaagctgattagagaaaaagacgaagaactccggaggatgcaagaaatgctccacaagattcagaaacaaatgaaggaaaactac

SEQ ID NO: 7429 - DNA, 1434 bp, Artificial Sequence
  Description of Artificial Sequence: Synthetic Transcript Sequence
atggatcgaagcctaggttggcagggcaattccgttccagaagataggaccgaagccggtattaaacggttcctggaggatacaactgacgacggggagttgtcaaaattcgtgaaagatttctctgggaacgctagttgccaccccccagaagctaaaacctgggctagccggccccaggttcctgagcctcgaccccaggcgccagatttgtatgacgatgatctcgaattccggccaccatcacgtccacagtccagcgataatcagcaatacttctgtgccccggccccactttctccatcagcacgcccccgttcaccttggggtaagcttgacccttacgacagctctgaggatgacaaggagtacgtcggattcgctacactgcccaatcaggtccaccgaaaaagcgttaagaaagggtttgatttcaccctgatggttgcgggtgagtctggcctcggcaagtcaaccttggttaactccctgttcctcactgacctataccgggaccgcaaactgcttggggccgaggagcgcattatgcagactgtcgagataaccaagcacgcagttgacatcgaggaaaagggggtccgtctgcgactgacaattgtggatactcccggattcggagatgccgtgaataacaccgagtgttggaagcctgttgcggaatatatcgatcagcagttcgaacaatattttagggacgaaagtggcctcaataggaaaaacatacaagataatcgcgttcattgctgcctctattttatatccccattcgggcacggtctccgcccattggatgttgaatttatgaaggcactccaccagagagtcaatatcgtgcctatcttggctaaagccgatacacttacaccacctgaggtcgatcacaagaagcgcaagattagggaggagatcgaacacttcggcattaaaatttaccaattccctgattgcgatagtgacgaggacgaagactttaagcttcaggaccaggccctgaaagagtccatacctttcgcagtgatagggtccaacactgtcgtggaggcacgcggccggcgcgtacgaggacgcctctacccctggggcatagtcgaagtggagaatcccggccactgtgatttcgtcaaactgcggacaatgttggtccggacccacatgcaggacctgaaggacgtgactcgcgagacacactacgagaattatcgcgcgcaatgcatacagtctatgacccgccttgtggttaaggagcgtaaccggaacaaattgacccgggagtcaggcacagactttcccattccggcagtcccacccggaactgatcccgagactgagaaactcatacgcgaaaaggatgaagagctgcgccgaatgcaggagatgcttcacaagatccaaaagcagatgaaagagaactat

SEQ ID NO: 7430 - DNA, 1434 bp, Artificial Sequence
  Description of Artificial Sequence: Synthetic Transcript Sequence
atggaccggagtctggggtggcagggcaacagtgttcctgaagatcggaccgaggctgggataaaacgattcctagaagacacaacagacgatggcgaactgtcaaagtttgtgaaggatttttcgggaaatgcctcctgccaccccccagaggccaaaacctgggcaagccggccacaagtgccagagccacgccctcaggcgccagacctgtacgacgacgacctggagttccgaccaccttccagaccccaatcttctgacaaccaacagtatttttgcgcccccgctcccctgtcaccctcggccagaccaagatcaccttggggcaaacttgacccatacgatagttctgaagacgataaggaatatgtagggtttgcaaccctgccaaaccaggtgcatcggaagagcgtgaaaaaggggttcgattttactcttatggtggcaggagagagcgggctgggcaagtccaccctggtgaactcactgttccttaccgatctctaccgagaccgtaaactgcttggtgccgaagaacgcataatgcagaccgttgagataacaaagcatgccgttgatattgaagagaaaggcgttaggctcaggttgacaattgtggatactcccggattcggcgatgcggttaataacacagagtgctggaagcctgtggctgaatatatcgatcaacagtttgaacagtacttccgagacgaatcaggcctgaatcgcaagaacattcaggacaacagagtccactgttgtctctacttcatctcccctttcggtcacggcctcagaccacttgacgtagagttcatgaaagccttgcaccaaagagtgaacattgtgcccattcttgctaaagccgacactcttacgcctcccgaggtggatcacaaaaaacgtaagatcagagaggaaatcgagcacttcggcattaaaatttatcaattcccggactgcgattccgacgaagacgaagatttcaagctgcaggaccaggccttaaaagaatctatccctttcgcagtaatcggctccaatacggtcgttgaagctcgcgggcgaagggtgcgtggtaggctctacccatggggaatcgtggaggttgaaaatccaggtcactgcgactttgtaaagctgcggactatgctggtgcgtacccatatgcaggaccttaaggatgttactagggagacacattacgagaactacagggcacagtgtatccagagcatgactaggctggtggttaaggagagaaacagaaataagttaacccgcgagtccgggacggacttcccaattcccgcagtgccgcccgggacggaccccgaaacggagaaactgatcagggagaaggatgaggaattgagacgaatgcaggagatgctgcataaaatccagaagcaaatgaaggagaactat

SEQ ID NO: 7431 - DNA, 1434 bp, Artificial Sequence
  Description of Artificial Sequence: Synthetic Transcript Sequence
atggaccgctctctcggttggcagggaaacagtgtgcctgaggacaggaccgaggctggcataaagcgctttctggaggatacaaccgatgatggtgaactgtccaagttcgtgaaggacttttcaggaaatgcctcttgtcatccgccggaggccaaaacatgggccagtagaccgcaggttccagaaccaaggccacaagctccagacctttatgatgatgacctggagttccgccccccttcacgcccccagagcagcgacaaccagcagtatttttgtgccccggcccctctgtcgccgagtgccagacccagatccccctggggaaagctggacccttacgactcttcagaagacgacaaggagtatgtgggttttgctacgctgccaaatcaggtgcaccggaaatccgtgaagaaaggttttgatttcaccttaatggttgcgggggagtctgggctaggcaagagcacattggtgaacagcttattcctgacagatctgtatcgtgataggaagttgctgggtgccgaagaaaggatcatgcagaccgttgagataactaaacacgccgtagacatcgaggagaaaggggtccgcctgaggttaacgatagtggacaccccgggattcggtgatgctgtgaacaataccgagtgttggaagcccgttgcagagtatatagatcagcagttcgagcagtactttagggacgagagcggtctcaaccgcaaaaatatccaggataatcgggtccactgttgcctgtactttatctcgcccttcggccacggcttgagaccacttgacgtggaattcatgaaggctctgcaccagagggttaatatagttcccatactggccaaggcagacaccctgacacctcccgaagtggaccacaagaagaggaagattcgcgaggaaattgaacacttcggtattaaaatctaccaattccctgactgtgattcagatgaggatgaggattttaagctgcaggaccaggccttgaaggaaagcattccgtttgccgtcatcggaagcaataccgtcgtggaggccagagggagacgggtcagaggtcgtctatatccttggggtatcgtggaagttgagaaccctgggcactgtgatttcgtgaagctaaggacaatgctggtacggacccacatgcaagacctgaaggacgttactcgcgaaacccactacgaaaattatagagcccagtgcattcagtctatgacgcgactggtggtaaaagaacggaatcgaaacaagctaacacgagaaagtggcactgatttcccaattccagctgtgccccctggaacagacccagaaaccgagaagctcatccgcgagaaagacgaagagttaaggaggatgcaggaaatgttacataaaatccagaagcagatgaaagaaaattac

SEQ ID NO: 7432 - DNA, 1434 bp, Artificial Sequence
  Description of Artificial Sequence: Synthetic Transcript Sequence
atggataggtcactgggatggcaaggcaactcagtgccagaagatcggaccgaagcgggaatcaagcggtttttggaggacactaccgacgatggagaactgtcgaaattcgtgaaagacttctcgggcaatgcaagctgtcacccgcccgaagcaaagacttgggcgtcccggccgcaggtgccggaaccgaggccgcaagctccggacctgtacgatgacgatctggaatttaggccgccttccagaccgcaaagttcggacaaccaacaatacttttgcgcccctgccccgctctccccgtccgctagacctagatccccgtgggggaagctggatccatatgactcatccgaggatgataaggagtacgtgggtttcgccacgcttccaaaccaggtgcatcggaaatctgtcaaaaaagggttcgacttcaccctgatggtggctggagagagcggactgggaaagagcactttggtgaattcactcttcctcaccgacctttacagagataggaaactgctcggcgcagaggaacgaatcatgcagactgtcgagatcaccaaacatgcagtggacatagaagaaaagggcgtgcgcctccggctgaccatcgtcgatacgccgggattcggcgacgcggtcaataacaccgaatgttggaagccggtggctgaatacatcgaccagcaattcgaacaatacttcagggacgaatcgggtcttaaccgcaagaatatccaggacaaccgagtccactgctgcctgtacttcatctcgcccttcggtcatggactccgtccattggacgtcgagtttatgaaggcgctccaccaaagagtgaacatcgttccaattctcgcaaaagccgatacgttgacccctccagaggtagaccataagaagcgcaagatccgcgaggaaatcgagcacttcggaatcaagatttaccaatttcctgactgcgacagcgacgaagatgaggacttcaaacttcaggaccaggcactcaaggaatcgatcccatttgcggtgatcggttcgaatactgttgtcgaagcgagaggacggcgcgtccgtgggagactctatccttggggaatcgtggaagtcgaaaatccggggcattgcgatttcgtgaagctccgcactatgctggtgaggacccacatgcaagacctgaaagatgtcactcgagaaacccactacgaaaactaccgggcgcagtgcatccaatctatgactcggctggtggtgaaggagagaaacagaaacaagctgactcgggagtctggaaccgatttcccaatcccggctgtaccgccgggcactgaccctgagactgagaaactgatccgtgaaaaggatgaggagctgcgcagaatgcaggagatgctgcacaaaattcagaagcagatgaaggaaaactac

SEQ ID NO: 7433 - DNA, 1434 bp, Artificial Sequence
  Description of Artificial Sequence: Synthetic Transcript Sequence
atggaccggtcccttggttggcagggtaacagtgttccagaagaccggacggaggcagggattaagagatttctcgaggacactacagatgacggagaactgtctaaattcgtcaaggacttcagcgggaatgcctcgtgccacccacccgaggcgaagacatgggcgtctagaccccaggtgcccgagccaagaccacaggccccagacctgtacgacgatgacctggagttccgacccccatctcgtccacagtcatcagacaatcagcagtacttttgtgctcccgcccctcttagcccctctgccagacctcggtctccatggggcaaattagatccctacgacagctctgaagacgacaaagagtatgttggatttgccacgctccctaatcaagtgcacagaaaaagcgtgaaaaagggtttcgattttaccttaatggttgctggcgaaagtgggctaggaaaaagcacattggtcaactcgctgttcctgactgacttgtatcgtgacagaaaacttctcggggccgaggaacggatcatgcagactgtggagatcactaagcatgcagtggacattgaagagaagggcgtacggctgagattgactattgtggacacccctggctttggtgacgcagttaacaatacagagtgctggaagcccgtcgccgagtatatagaccagcagttcgagcagtacttccgggacgagtcaggactgaaccgcaagaatatccaggacaatagagtccactgctgtctctactttatcagccctttcgggcacgggctgcggcctctcgatgttgagttcatgaaagccttgcaccagagggtaaacattgtaccaatcctggcaaaggcggacaccctcacccccccggaggtggaccacaaaaaaaggaagattcgtgaggagattgagcattttggtattaagatttatcagttccctgattgtgacagcgacgaggacgaggacttcaagctgcaagatcaagcactgaaggaatcaattcccttcgcagtgatcggcagtaataccgttgtggaagcacgtggccgtcgagttcgagggaggttgtacccttggggtatcgtcgaggtcgagaatcctggccactgtgatttcgtgaagcttcgcaccatgctggtgaggacccacatgcaggacctcaaggacgtgacaagggagacacactatgagaattatagggcacagtgtatccagtctatgaccaggcttgtggtcaaggaaagaaacaggaacaaactgaccagggagtctggcaccgatttccctatcccagctgtgccccctgggactgacccagagacggagaagttgataagggagaaagacgaagagctcagaaggatgcaggagatgctgcataagatccagaaacagatgaaagagaattac

SEQ ID NO: 7434 - DNA, 1434 bp, Artificial Sequence
  Description of Artificial Sequence: Synthetic Transcript Sequence
atggaccgcagtctggggtggcagggcaactccgtgcccgaggacaggactgaggcaggcattaagaggtttcttgaagatacgacagatgatggtgaactgtcaaaattcgtgaaggacttcagcggaaacgccagctgccatcccccagaagcaaagacctgggctagtcggcctcaggtgcccgagcctagacctcaggcaccagatctctacgacgatgacctggaattcaggcccccttctcgaccccagagcagcgataaccaacaatacttctgtgcccccgctcctctatctccttcagctcgcccccgttctccttggggtaaattggatccatacgactcaagtgaagatgacaaggagtatgtgggattcgcaactctcccaaatcaggtccaccggaagtctgtgaagaagggatttgacttcaccttgatggtcgcaggcgagagcgggcttgggaaatcgaccctcgtgaattcactttttctgaccgacttgtatcgggaccgtaagcttcttggtgctgaggaacggatcatgcagacggtcgagatcacaaagcacgccgtcgatattgaggagaaaggcgtccgccttagattaactatcgtggacacacctgggtttggcgacgctgtgaacaatacagagtgttggaaaccagtggccgagtacatcgaccagcagtttgaacagtatttccgggatgagtcaggcctgaatcgcaaaaacattcaggacaatcgtgtccactgttgcctgtactttattagccccttcggccatggcctgagaccccttgacgtggagtttatgaaggcactccaccagcgggtgaacattgtaccaatcttggccaaggcagataccctcacaccgcccgaggtcgaccacaagaaacgtaaaattcgagaggaaatcgagcattttggtataaaaatataccagttccccgactgcgacagcgatgaagatgaggatttcaaactgcaggaccaggccctgaaggagagcataccatttgccgttataggcagtaacacagtggtcgaggcgcgcggacggcgagtacgcggcagattgtacccctggggaattgtggaggtcgagaatcccggacactgcgatttcgtgaagctcagaaccatgctcgtccgaacacatatgcaggacctaaaggatgtaacgcgggagactcactacgaaaactaccgcgctcagtgcattcagtccatgacccgactggtggtaaaggaacgaaatcgcaacaaactgacacgtgagagcggcaccgattttccaattcctgcagttccaccgggtacggaccctgaaactgaaaagcttatccgggaaaaagacgaggagcttcgccgaatgcaagagatgctccacaaaatccagaagcagatgaaggagaattac

SEQ ID NO: 7435 - DNA, 1434 bp, Artificial Sequence
  Description of Artificial Sequence: Synthetic Transcript Sequence
atggacaggtctttgggatggcaagggaactccgtgccggaggacaggaccgaagctggaatcaagcgctttctggaagataccaccgacgatggcgaactttccaaattcgttaaggacttctccggaaacgcatcctgtcatccgccagaagccaagacctgggcgtcccgcccgcaggtccctgaaccgcgcccacaggccccagacctgtacgacgacgatctcgaattcaggccaccgagtcggccgcagagctcagataatcagcagtacttctgcgccccggctccgctgtccccttcagcacgtccccgctcaccctggggaaagctggatccgtacgacagctcagaggacgataaggagtacgtgggattcgcgactctgccgaaccaggtccatagaaaatcagtcaagaagggattcgacttcactctgatggtggcgggagagtcgggcttgggaaaatcaaccctcgtgaactccttgttcctcaccgacctgtacagagatcggaagctgctcggagccgaagaaagaatcatgcaaaccgtggagatcaccaagcacgcggtcgacatcgaggaaaaaggagtgcgcctgcgcttgactatcgtggatacccccggcttcggggatgccgtgaacaacaccgaatgttggaaacctgtcgcggagtatatcgatcagcagttcgaacagtactttcgggacgaatccggattgaacaggaagaatattcaggataatcgggtgcactgttgcctctacttcatctccccatttggacacggactccgaccgctggatgtggaattcatgaaagccctgcaccagcgcgtgaacatcgtcccgatcctggcgaaggccgacaccctgaccccacctgaagtcgatcacaagaagcggaagatccgggaagaaatcgaacatttcggtatcaagatctaccagttcccggactgtgattcagatgaggacgaggacttcaagctgcaggatcaagcgctgaaggaaagcatcccgttcgcagtgatcggatcgaatactgtggttgaggcgagagggcggcgagtccgcggacggttgtacccgtggggaatcgtggaggtggaaaacccggggcactgcgactttgtcaagctccggacgatgctggtgcgcactcacatgcaggacctgaaggacgtgacgagagagactcattacgagaactaccgcgctcagtgcatccaatccatgaccagactcgtggtgaaggaacgtaatagaaacaagctgactagagaatcgggcaccgacttcccgatcccggccgtgcctccgggaactgacccggaaacggagaagctcattagagaaaaagatgaggaactccgacggatgcaggagatgctgcataagatccaaaagcagatgaaagagaactac

SEQ ID NO: 7436 - DNA, 1434 bp, Artificial Sequence
  Description of Artificial Sequence: Synthetic Transcript Sequence
atggaccggtccctggggtggcagggaaattcagttcctgaggacagaaccgaggctggcatcaaacgcttcctggaagacactactgatgatggggagctgtcaaaattcgtcaaggatttttctggaaatgccagctgtcaccccccagaggctaaaacgtgggccagtagaccccaggttcctgagccacgaccgcaggcacccgacctgtacgacgatgacctggagtttagaccaccgtccagacctcaaagttctgataaccagcagtacttctgcgcaccagcaccccttagtcctagtgccaggcccagatccccatggggaaagttggacccgtacgacagcagtgaggacgacaaagagtatgtgggcttcgcaaccctcccgaatcaagtccaccgaaagtcagtcaagaagggcttcgactttactctgatggtggcaggcgagtcagggctggggaagtccacactggtgaattctctgtttctgacagacctttacagggataggaagctgctgggggctgaagaacgcattatgcagaccgtggagataaccaagcacgctgttgatatagaggagaaaggagtgcgcttgcggctcacgattgtggacacacctggctttggggatgccgtcaacaacacggagtgttggaagcctgtcgccgagtacattgatcagcaatttgagcaatactttagagatgagtccggactcaatcgaaaaaacattcaggataaccgggtgcactgctgcctgtactttatcagcccatttggtcacgggctgagaccacttgacgtagagttcatgaaggcgctgcatcaacgagtaaatattgttcctattcttgccaaggccgacacgctgactccaccagaagtagaccacaaaaagagaaagatccgcgaagaaattgagcacttcggaattaaaatctaccagttcccggattgtgatagcgacgaggacgaggacttcaaactccaggaccaggccttgaaagagtctataccatttgccgttattggttccaatacggtcgtcgaagctagaggtcggcgcgtcagagggcggctgtatccctggggaattgtggaggtcgagaacccaggccactgcgattttgtgaaactgcgaaccatgctggtgaggacccacatgcaggatctgaaagacgtcacacgcgagacacattacgagaactatcgcgctcagtgcatccagtctatgacccggcttgttgttaaggagagaaatagaaataagctcacccgagagtccggcaccgacttccccatacctgctgtccctcccggcactgaccctgagaccgagaaactgataagagagaaggacgaggaactgcgcagaatgcaggagatgctgcacaagatccagaaacagatgaaggagaactat

SEQ ID NO: 7437 - DNA, 1434 bp, Artificial Sequence
  Description of Artificial Sequence: Synthetic Transcript Sequence
atggacaggtctctaggctggcagggcaactccgtccccgaagatcgaaccgaggccggtatcaagcgcttcttggaagacaccaccgacgatggcgagctgtcaaaatttgtcaaagacttttcaggcaatgctagttgtcacccaccagaagccaagacctgggcttccagaccccaagtacccgaacccaggccgcaggctcccgatctgtatgatgatgatctggaattcaggcctccatcccgcccacagagctctgataaccagcagtacttttgcgcccctgcacctctgagcccctcagcaaggcccagaagcccttggggtaagttggacccttatgattcttcagaggatgataaagaatacgtagggttcgcgacactgcctaatcaggtgcatcggaaatctgtgaaaaaggggttcgactttacactgatggtcgctggagaatccgggctcggaaagtcaacactggtgaactctctgttccttacagacctgtacagggatcgcaaactgctcggggccgaagagagaatcatgcagaccgtggaaatcacgaagcacgctgtggacattgaggaaaagggggtgagactgcgcttaacgattgtggacaccccgggattcggcgacgcagtcaataacaccgagtgctggaaaccagttgcagagtatattgaccaacagttcgaacagtatttcagggacgagtcgggcctcaacaggaaaaatatacaggacaaccgtgtgcattgctgcctgtacttcatatcaccattcggccatggtctcagacccctagatgtagaattcatgaaggccctacaccagagggtcaacattgtgcctattttggctaaggccgacaccttaacccctcccgaggtggatcataaaaagcgaaagatccgtgaggaaattgaacacttcggaatcaagatttaccagtttccagactgcgattcggacgaggacgaagactttaagctgcaggaccaggccttgaaggagtcaattccttttgccgtcataggatctaatacggtggtggaagccaggggcagacgagtcagaggtagactgtacccctggggaatcgtagaggtggaaaacccaggacactgcgatttcgtgaaactacgaaccatgcttgtaagaacccacatgcaagacttgaaagacgtaacccgcgaaactcattacgaaaactatcgggcgcagtgtattcagagcatgaccaggctggtggtgaaagagaggaaccgaaataagctcacccgagaaagtggcacagatttcccaatccccgcagttcctcctggaacagaccctgagacagagaaactaattagagagaaagacgaggagctccgcagaatgcaagagatgctacacaagatacagaagcagatgaaagaaaactat

SEQ ID NO: 7438 - DNA, 1434 bp, Artificial Sequence
  Description of Artificial Sequence: Synthetic Transcript Sequence
atggaccgcagccttggctggcagggaaacagcgtgccggaagatcgtaccgaggctggaatcaaacgctttctcgaggataccactgatgacggagaactgagcaagttcgtcaaggacttctcgggaaatgcctcctgccatcctccagaagcaaagacgtgggcctccagaccgcaagtgccagagcctcgcccgcaggcgcctgatctgtacgacgacgacctggaattccggcccccatcgcggccgcagtcgtcagataaccagcagtacttttgcgccccggcgcctctgtctccgtcggcccgccctcggagtccctggggtaagctcgacccttacgattcgtcggaggacgacaaagagtacgtgggttttgccacgctgccgaaccaagtccacaggaagtctgtgaagaaagggtttgatttcacccttatggtggccggcgaatccggtttgggaaaaagcaccctcgtcaacagcctcttcctcaccgatctctacagagatagaaaactgctgggagcggaggaaagaatcatgcagactgtcgaaatcactaaacacgccgttgacatcgaagagaagggtgtccggttgcgcctgactattgtcgatactcctgggttcggcgacgctgtgaataacaccgagtgctggaagcccgtcgcggaatacatcgaccagcaattcgagcagtactttcgggacgagtcggggctcaaccgcaagaacatccaggacaaccgcgtgcactgctgcctgtacttcatctctcctttcggtcatgggctcagacctcttgatgtggaattcatgaaggcccttcatcaacgagtgaatatcgtgccaattcttgccaaggcagatacgttgacccctcccgaagtggatcacaagaagcggaaaatccgcgaagaaatcgagcatttcgggataaagatctaccagttcccggactgtgattcggatgaggacgaggactttaaacttcaagaccaagcattgaaggaatcaatcccattcgcggtgatcggatcaaatactgtggtggaggcgcgcgggagacgggtgcgcggaaggctgtacccgtggggaatcgtggaggtcgaaaatccggggcactgcgacttcgtgaaactgcgcaccatgctggtaagaacccacatgcaggaccttaaggatgtcactcgggagacgcactatgaaaactacagagcccagtgcatccagtcgatgactcggctcgtggttaaagaacgcaaccggaataagctgactcgcgaatccggaaccgatttcccaatccccgctgtcccccctggaaccgacccggagactgaaaagctgatccgcgagaaagacgaggagttgcggcgcatgcaggagatgctgcacaagatccagaagcagatgaaggagaactac

SEQ ID NO: 7439 - DNA, 1434 bp, Artificial Sequence
  Description of Artificial Sequence: Synthetic Transcript Sequence
atggacagaagcttggggtggcaaggcaatagcgtccctgaagataggacagaggccgggatcaagcggtttctggaagacactactgatgacggcgagctgagcaaattcgtgaaagatttctcaggcaatgcgtcctgccaccctcccgaggccaagacatgggcctcgagacctcaggttccagagccacggccacaggccccagacttgtatgacgacgatctggaattccgacccccgtcccgtcctcagtcctccgacaaccagcagtacttttgtgcacccgctcctctgtctccttccgctaggccaaggagcccatggggaaagctcgatccatatgattctagcgaagacgataaagaatatgtgggctttgctacacttcccaatcaagttcacaggaagtccgtgaagaaggggttcgattttacactcatggtggcaggggagtcaggcctgggcaaatcgacactggttaacagcctcttcttgaccgatctgtaccgggacaggaagctcctgggagccgaggaaagaataatgcaaaccgtggaaattacgaagcacgccgtggacattgaggagaaaggagttcgactgcgcctcaccattgtcgacacccccgggttcggtgatgccgtcaacaataccgaatgttggaaacctgtagctgaatatatcgatcagcagtttgagcagtactttagagacgagagcggtctgaacaggaaaaacatccaagataatcgggtgcactgctgcctgtacttcatttcacccttcggccacgggcttaggcccctcgatgtggaatttatgaaggctttacaccagcgcgttaatatcgtcccgattttagccaaagctgatactctgacaccacctgaggtcgatcataagaagagaaaaattagggaggagatcgagcattttggtattaaaatatatcagttccctgactgcgattcagatgaagacgaagactttaaacttcaggaccaggccctgaaggaatctattccctttgccgtgatcggctccaatacagtggtcgaggctaggggaaggagagtgcggggacggctttacccgtggggcatcgttgaggtcgagaaccccggacactgcgattttgtgaaactaaggacgatgctggtgagaacacacatgcaggacttgaaagacgtgacgagagagacacactatgagaattatcgggcacagtgcatacaatccatgactagacttgtggtgaaggaacgcaaccgaaataaactgaccagggaatccgggactgattttccaattccagctgtaccccccggcactgacccagagacagagaaactcattagggagaaagacgaggaactgcgtcggatgcaggagatgctccataaaatccaaaagcagatgaaggagaattat

SEQ ID NO: 7440 - DNA, 1434 bp, Artificial Sequence
  Description of Artificial Sequence: Synthetic Transcript Sequence
atggacaggtcactgggttggcaaggtaattcagtgccagaagaccggaccgaagcgggcataaaacgatttttagaggatactaccgacgacggggagttgagtaaatttgtaaaggacttcagcgggaatgcttcttgccatccccccgaagctaaaacatgggcgtcaaggccgcaagtacctgaaccgaggccccaggcccccgacttgtacgatgatgatctggaattccgccctcctagccgcccccagtcttcagacaatcaacagtacttttgcgcccccgcacctttgtcaccctctgcaaggcctagaagcccctgggggaagctggatccttacgatagttcagaagatgacaaggagtacgttggcttcgctacactcccaaaccaggtacaccgcaagtcagtcaaaaagggatttgatttcacgctgatggtagccggagaaagcgggttgggtaaatccacgctagtaaactcattattcttgaccgatctgtatcgggatcgtaagctgctgggtgccgaagaaagaatcatgcagaccgtcgaaatcactaagcacgccgtagacatagaggaaaaaggcgttagactccgcttgacaattgtagatacacccggcttcggcgacgctgtcaacaatacggagtgttggaaacccgtcgccgagtatattgaccaacagtttgaacaatactttcgagatgagagtggcctaaacagaaagaacatccaagataatcgcgtgcactgctgcttatatttcatttcaccttttgggcatggactacggcccctagatgtggagtttatgaaggccctgcaccaacgcgtaaacatagtaccgattctggcaaaggccgacactctgactccaccagaagtagatcacaagaagaggaagattcgagaggaaatcgaacactttggaataaaaatctaccagtttccggactgcgattcagacgaagacgaggactttaaactgcaggaccaagcgctaaaagaatccattccttttgccgtaatcggctcgaacacagtggtggaagcgcggggcagacgcgtgaggggcagattgtacccgtggggcattgtggaagtcgagaatcccggccattgtgattttgtgaagctgcgcactatgctggtcagaacccacatgcaggatctgaaagacgtgacccgggaaacacattacgaaaactatagagcacagtgtatccaatcaatgacccgcctggtggtgaaagaaaggaacagaaacaaactcacccgggagtcgggaactgatttcccgatcccagcagtgccgcccggaactgaccccgaaactgagaagctgatcagggaaaaagacgaggagctgcgcagaatgcaggaaatgcttcacaagattcagaagcagatgaaggagaattat

SEQ ID NO: 7441 - DNA, 1434 bp, Artificial Sequence
  Description of Artificial Sequence: Synthetic Transcript Sequence
atggaccgctctctggggtggcagggaaattcagtgccggaggatcgcacggaagcaggcattaagaggtttctggaagatactaccgacgacggagagctgagcaagttcgtgaaggacttctccggcaacgccagctgccaccctccggaagccaagacctgggcgagccggcctcaagtgccagagccgcggccacaagcgccggacctctacgacgatgacctcgagtttcgcccaccatcccgcccgcaatcgtcagataaccaacagtatttctgcgccccggctcctttgtcacctagcgccagaccgcgaagcccttggggcaagctggacccgtacgactccagtgaggacgacaaggaatacgtggggttcgcaactcttcccaaccaggtccaccggaagagcgtgaagaagggatttgacttcacccttatggtcgctggagagtcaggactcggtaagagcaccctcgtgaacagcctgtttcttactgacctctaccgcgatcgcaagctcctcggggcagaggaacgaattatgcagactgtggaaatcactaaacatgcagtcgacatcgaagagaaaggcgtgaggcttaggctgactatcgtggatacccctggcttcggagatgcggttaacaacaccgaatgttggaaaccagtggccgaatacatcgaccaacagttcgagcaatactttcgggatgagagcggactgaaccgcaaaaacatccaagataatcgcgtgcattgctgcctgtacttcatttccccattcggtcatggtttgcgcccgctggatgtggaattcatgaaggctctgcatcagcgggtgaatatcgtgccgatcctggccaaggctgataccctcacgccaccggaggtggatcacaagaagcggaagatccgggaggagatcgagcacttcggcatcaagatctaccagttcccggattgcgacagcgatgaagatgaagatttcaagctccaagatcaggccctgaaggagtcgatcccttttgcagtgatcgggtctaacacggtcgtcgaagcacggggccgcagagttcggggacggctctacccctggggtattgtcgaggtggaaaaccctggtcattgtgacttcgtgaaactgagaaccatgttggtgcgcactcacatgcaggatctgaaagacgtgactcgcgaaacccactatgagaattaccgcgcacaatgcatccaatcgatgactcggctggtcgttaaggaacggaaccgcaacaagctgactcgcgaatccggcactgacttccccataccggctgtgcctccggggactgacccggaaactgagaagttgatccgggaaaaggacgaagaactgcgccggatgcaggaaatgctgcacaagatccagaaacaaatgaaagaaaactac

SEQ ID NO: 7442 - DNA, 1434 bp, Artificial Sequence
  Description of Artificial Sequence: Synthetic Transcript Sequence
atggatagatctctgggatggcaaggtaactcggtgcctgaggatagaactgaggcaggtattaagcgtttcctcgaggatactaccgatgatggtgaacttagcaagtttgtgaaggatttttcaggtaacgcatcgtgtcaccccccagaggcaaagacgtgggcatcaagacctcaagtcccagaaccccggccgcaagcaccagatctgtatgatgatgatcttgaatttcggccgccttcgaggccccaatccagcgataatcaacagtacttctgtgcgccggccccgttgtcgccatctgccaggccgcgttcaccttggggaaaactggacccgtacgattcctcggaagatgacaaagaatatgttggatttgctactctgccaaatcaggtccatcgcaagagcgtcaaaaagggttttgattttaccctgatggtcgcaggggaatctggtctgggaaagagcactcttgtgaactccctgttcctgaccgatctgtacagggataggaaacttcttggtgctgaagaacggatcatgcaaaccgtggagatcactaagcatgcagtggacatcgaagaaaagggagtgcgcttgagacttacgattgtggatactcctggctttggagacgcagtgaataacactgaatgttggaaacctgtggcggagtacatagatcaacaatttgagcagtacttccgggacgaatccggcctcaaccgcaagaatatccaggataatcgggtgcactgttgtctttacttcattagccccttcgggcatggactgcgcccgttggatgttgagtttatgaaagcactgcatcaacgcgtcaacatcgtgcccattcttgctaaggcggacacccttacccctcctgaagtggatcataagaagagaaagatccgcgaagagattgaacatttcgggataaagatttaccagtttccagattgcgattcagatgaggacgaggacttcaaactccaggaccaggcactcaaagaatctatcccatttgctgtgattggaagcaataccgtggtggaagcacggggacgccgcgtccggggtcgtttgtacccttggggcattgtggaggtcgaaaaccccggacactgtgactttgtgaagctgagaactatgcttgtgcgaacccacatgcaagaccttaaagacgtgactagagaaacccactacgaaaactatcgggcccagtgtattcagtccatgacccggctggtcgtgaaagaacgtaatagaaacaaactcactcgagaatcaggtactgatttccctattcctgcggtgccacccgggactgaccctgaaacggaaaagctgataagggagaaagacgaagaacttcgtcgcatgcaggaaatgctgcataagatacaaaaacaaatgaaggagaattac

SEQ ID NO: 7443 - DNA, 1434 bp, Artificial Sequence
  Description of Artificial Sequence: Synthetic Transcript Sequence
atggaccggtcccttggttggcagggaaactcggtccctgaagatagaacggaggcagggattaagcggttcctggaggacaccactgacgacggtgaactctcgaaatttgtgaaggatttttcgggaaacgcgtcctgtcacccgcctgaggccaagacctgggcgagccggccgcaggtgcctgaaccccggcctcaggcccctgatctgtacgatgacgacctcgagtttcgtccaccttcacgcccacagagctcagataatcagcaatacttttgtgctcccgcaccactgtccccatcggcaagacctcgatctccttggggaaaactggacccttacgattcatcggaggacgacaaggagtacgtgggatttgcaacgctgcctaaccaagtgcatcgtaagagcgtgaaaaagggtttcgattttaccctgatggtggcgggagagagtggacttggaaagtccacccttgtgaatagcctttttctgactgatctctacagggacagaaagttgctcggggcggaagaacggattatgcagaccgtcgagattaccaagcatgcagtggacatcgaagaaaagggcgtgaggctccgcctgacgatcgtcgatactcctggattcggggatgccgttaacaacactgagtgctggaagcctgtcgcggaatacattgaccagcaatttgagcagtactttcgtgacgagtcaggccttaaccgcaagaacattcaagataaccgggttcattgttgcctgtactttatcagcccttttggacatggtttgaggcctcttgacgtggaattcatgaaagcccttcatcaaagggtgaacatcgtccctatactggcaaaagcagacactctgactccacctgaagtggaccataagaagcggaagatcagagaagagattgaacacttcggaatcaagatctaccagtttcctgattgcgactcggacgaagatgaggatttcaagctccaggaccaagccctcaaagagagcatcccctttgccgtaattggttcaaatactgtcgtcgaagcacgcggtcgacgcgtgagaggacggttgtatccatggggaatcgtggaagtcgaaaacccgggacattgcgattttgtgaaacttaggactatgcttgtgaggacccacatgcaggacttgaaggacgtcactagagaaacccattacgaaaactatagagcacaatgcattcagagcatgacccggcttgtcgtgaaggagaggaatagaaataagctcactagagagtccggcactgattttcctattccagcagtgccccccggaaccgatcctgaaaccgaaaagctcattagggagaaggatgaggagcttcgacgtatgcaagaaatgctgcacaaaatccagaaacagatgaaggaaaactat

SEQ ID NO: 7444 - DNA, 1434 bp, Artificial Sequence
  Description of Artificial Sequence: Synthetic Transcript Sequence
atggatcgttcgctaggttggcaaggtaattcggttccggaagatcgaacggaagcgggtataaaacgatttttagaagatacgacggatgatggtgaactatcgaaatttgtaaaagatttttcgggtaatgcgtcgtgtcatccgccggaagcgaaaacgtgggcgtcgcgaccgcaagtaccggaaccgcgaccgcaagcgccggatctatatgatgatgatctagaatttcgtccgccgtcgcgtccgcaatcgtcggataatcaacaatatttttgtgcgccggcgccgttatcgccgtcggcgcgtccgcgttcgccgtggggtaaattagatccgtatgattcgtcggaagatgataaagaatatgttggttttgcgacgctaccgaatcaagtacatcgtaaatcggttaaaaaaggttttgattttacgttaatggtagcgggtgaatcgggtctaggtaaatcgacgctagtaaattcgttatttttaacggatctatatcgtgatcgtaaactactaggtgcggaagaacgtataatgcaaacggtagaaataacgaaacatgcggtagatatagaagaaaaaggtgttcgtttacgtttaacgatagtagatacgccgggttttggtgatgcggtaaataatacggaatgttggaaaccggtagcggaatatatagatcaacaatttgaacaatattttcgagatgaatcgggtctaaatcgtaaaaatatacaagataatcgagttcattgttgtctatattttatatcgccgtttggtcatggtctacgtccgttagatgtagaatttatgaaagcgttacatcaacgtgttaatatagtaccgatattagcgaaagcggatacgctaacgccgccggaagttgatcataaaaaacgaaaaatacgtgaagaaatagaacattttggtataaaaatatatcaatttccggattgtgattcggatgaagatgaagattttaaattacaagatcaagcgttaaaagaatcgataccgtttgcggtaataggttcgaatacggttgtagaagcgcgaggtcgtcgagttcgtggtcgactatatccgtggggtatagtagaagtagaaaatccgggtcattgtgattttgttaaattacgaacgatgctagttcgtacgcatatgcaagatttaaaagatgtaacgcgagaaacgcattatgaaaattatcgagcgcaatgtatacaatcgatgacgcgattagtagttaaagaacgtaatcgtaataaactaacgcgagaatcgggtacggattttccgataccggcggtaccgccgggtacggatccggaaacggaaaaactaatacgtgaaaaagatgaagaactacgtcgaatgcaagaaatgttacataaaatacaaaaacaaatgaaagaaaattat

SEQ ID NO: 7445 - DNA, 1434 bp, Artificial Sequence
  Description of Artificial Sequence: Synthetic Transcript Sequence
atggaccggtctctgggttggcagggcaatagcgtgcccgaggatcgaacagaggcgggcatcaaaagattccttgaggacaccacggatgatggggaactgagcaagttcgtcaaggatttttctggtaatgccagttgccaccctccggaggccaaaacatgggccagcagacctcaggtgcccgaaccccgtccccaagctcctgacctctatgatgatgacctggaattccgaccaccaagccgcccccaatcatcagataatcaacagtatttctgtgcaccagcacctctctcccccagtgcccggccacgcagcccatggggcaagttggatccttacgattcttcagaggatgacaaagaatacgtcggctttgccacacttccaaatcaggtgcacaggaagtcggtgaagaaagggtttgactttactctaatggtggctggcgagtcgggcctaggcaaatcaacgctagtcaatagcctgtttctgaccgatctgtacagagaccggaaactcctgggggcagaagaaaggatcatgcagacagttgagattactaaacacgcggtggatattgaagaaaaaggggtgcgactgagattaactattgtcgacactccaggcttcggcgacgctgttaacaacactgagtgttggaaaccagtagcagagtacatcgatcaacagttcgagcaatactttcgggatgagagcgggctgaaccgcaagaatattcaggataaccgggtccactgctgtttgtatttcattagtccttttggccacggcttgcggcccctggatgtggagtttatgaaggcactccatcagcgtgtaaatatagtacccatactcgcaaaggccgacactctgacaccacccgaggtggaccacaagaagaggaagattcgtgaggagatcgagcacttcggaataaagatataccagttccctgactgcgactcagacgaggatgaagactttaagcttcaggatcaggcccttaaggaatccatccccttcgccgttatagggtccaataccgtggtcgaggctaggggccggagagtccgtggacggctctatccatgggggattgtagaggtggagaatccaggacattgtgatttcgtcaagctccggacaatgttggttcgaacgcatatgcaggatctgaaggacgttaccagagaaacccactatgagaactacagggcgcagtgcatccagtccatgactcgcctggtggtgaaggagcggaacaggaataaactgacacgcgaatcgggaaccgacttcccaatccccgctgtcccgcctggaaccgaccctgagaccgagaagctcatccgggaaaaagacgaagaactccgccgaatgcaggaaatgctccacaaaatccagaaacagatgaaagagaactac

SEQ ID NO: 7446 - DNA, 1434 bp, Artificial Sequence
  Description of Artificial Sequence: Synthetic Transcript Sequence
atggaccgttcccttggttggcagggcaacagcgtgccagaagatcgaactgaggcgggaatcaagcgcttcttggaggacacgactgatgatggagaactgtcgaagttcgtcaaggatttctcgggaaacgcatcgtgccatcctccggaagctaaaacttgggcctcaaggccacaggtgcctgagccccggccacaagccccggacctgtacgacgatgacctggagtttagacctccctccagaccgcaatcctccgataaccaacaatacttttgcgcgccagcgccgcttagcccttcggctcgcccacggagcccttggggaaagctggatccctacgactcctcagaagatgacaaagagtacgttggattcgccactctcccgaaccaggtgcacaggaagtccgtgaagaaggggtttgacttcactctgatggtcgctggcgagtctggactcggaaagtctactctcgtcaactctctcttcctgaccgacctgtaccgcgatcgcaaactcctcggggccgaagaaaggataatgcagacggtggaaattaccaagcacgcagtggatatcgaggaaaaaggagtgcggctgcggctgaccatcgtggacactccgggtttcggtgacgctgtcaacaataccgaatgttggaagcctgtggcggagtatattgaccagcagttcgagcagtacttccgcgacgagagcgggctgaatcgcaagaatatccaggacaatcgcgtgcattgctgcttgtatttcatctcgccattcggacacggtctgaggcctttggacgtggaattcatgaaagctctccaccaacgcgtcaacattgtgccgatcctggccaaggccgataccctgaccccgccggaggtcgatcacaaaaagcgtaagatccgggaggaaatcgaacatttcggaatcaagatctaccagtttccggactgcgactcggacgaggacgaggatttcaaactgcaggaccaagcgttgaaggaaagcatcccctttgcagtgatcggatcaaacaccgtcgttgaggcacggggacgacgcgtgagaggccggttgtacccttgggggatcgtggaagtggaaaatcccggccactgtgatttcgtgaagttgagaaccatgctcgtgcggacccatatgcaggacctcaaggacgtgactcgcgaaacccactacgagaattaccgggcccagtgcatacaatcgatgaccaggctcgtcgtcaaagagagaaacagaaacaagctcactagagagagcgggaccgattttccgatccccgccgttccgccaggcactgacccggaaactgagaagctgattcgtgaaaaagatgaggaacttcgtcgcatgcaagaaatgttgcacaagatccagaagcagatgaaagaaaactac

SEQ ID NO: 7447 - DNA, 1434 bp, Artificial Sequence
  Description of Artificial Sequence: Synthetic Transcript Sequence
atggatagatcattgggttggcaaggaaactcggttcctgaggacaggactgaggcgggaataaaaaggtttcttgaggatactactgatgatggagaactttcgaagttcgtcaaagacttctccgggaatgctagctgccatcctcctgaagcgaaaacatgggcctcccgcccacaagtgcctgaacctcgtcctcaagcacctgacttgtacgatgatgatctcgagttcagacccccctctagaccgcagagcagtgataaccaacaatatttttgcgcgcctgcccccttatccccgagtgctcgcccaaggtcgccctggggaaaattggatccgtacgatagttcggaagatgataaggaatatgtcggtttcgccacgttgccaaatcaggtccatcgtaaatccgtaaagaaaggatttgacttcacacttatggttgcaggcgaatccgggttgggtaagagtaccttggttaacagcttgttcttaactgatctctacagggaccggaagcttctaggtgctgaggagagaattatgcaaactgtggagattacaaaacacgcggttgacatcgaggaaaagggtgtgcggcttagattgactatcgtggacaccccgggtttcggagatgcagttaataatacagaatgctggaaacctgtcgccgagtatatcgatcaacagttcgaacaatattttcgcgatgaaagtggacttaatagaaaaaatatccaagataaccgtgtccactgctgtctttactttattagtcctttcggtcatgggttacgccctctcgatgtggagttcatgaaggccctccaccagcgcgtcaatattgttcctattttagccaaagctgataccttgaccccaccagaagtcgatcacaaaaagcgcaagattcgtgaggagattgaacattttggcattaagatttaccaatttcccgattgcgactccgatgaagatgaggacttcaagcttcaagatcaagctcttaaagagtctattccgttcgcagtcattggatccaacacagttgtcgaagctaggggacgcagagtcagaggaaggctttacccttgggggatcgtcgaagtggaaaatccgggtcattgcgattttgttaagttgcgtaccatgctggttcgaactcatatgcaagatcttaaggatgttactcgtgagactcattatgagaactacagagctcagtgtattcaatctatgacgcgactggtggttaaggagcgaaataggaataagctgacacgggaaagcggtacagatttcccaattccagcagttccccctggaactgaccccgaaaccgagaagttaattcgcgagaaagatgaggaattacgtaggatgcaagaaatgctccataagatccagaagcaaatgaaagaaaattac

SEQ ID NO: 7448 - DNA, 1434 bp, Artificial Sequence
  Description of Artificial Sequence: Synthetic Transcript Sequence
atggacagaagcctcggttggcaaggaaattcggtgcctgaggaccggaccgaagcaggaatcaaacgcttcctggaagataccacggacgacggggaactctccaaatttgtcaaagacttttcaggaaacgcgagctgccacccgcctgaggccaaaacttgggcctcgcggcctcaggtgccagaaccaaggccgcaggcgcctgacctctacgatgatgacctggaattccggcccccgtcccgcccgcaatcatcggataaccaacagtacttttgcgcaccagcgcctctgagcccaagcgctcgcccccgctcgccctggggcaagttggacccatacgactcaagcgaggatgacaaggagtatgtcggcttcgcaactctgccgaatcaagtccatcggaagtcagtaaagaaaggattcgacttcaccctcatggtggctggcgagagtggactgggaaagtccactcttgtgaactccttgtttctgacggacctgtaccgagatcgaaagctccttggtgcggaagaacggatcatgcagactgttgaaatcactaagcacgcagtcgacatcgaagaaaaaggcgtcaggctgcgcttgaccattgtggacaccccaggatttggggacgccgtgaacaacactgagtgctggaagccagtcgcagaatacattgatcagcaattcgagcaatacttcagggatgagagcggtcttaatcgcaagaatatccaagacaatagggtgcattgttgtctgtacttcattagcccttttggacacggactccgcccgctcgacgtggaattcatgaaagcccttcatcagcgagtgaatatcgtgccgatcctcgcgaaggccgatactctgaccccgccggaggtggaccacaagaagcgcaaaatcagagaggaaatagaacacttcggaatcaagatatatcagtttccggactgcgatagcgacgaagatgaggacttcaagctgcaggaccaagctctcaaagaatccatcccattcgctgtgatcggctccaacaccgttgtcgaggcccggggtcgcagggttagaggtcgcctgtacccgtgggggatcgtggaagtggagaacccgggccactgcgacttcgtgaagctgcggactatgttggtgaggacccacatgcaggatctgaaagacgtgacccgcgagactcattacgagaattatcgggcacagtgcatccagtcaatgaccaggcttgtggtaaaggagcgaaacaggaacaagctgaccagagaatctgggaccgatttcccgatccccgcagtgccgccgggaacggatcccgaaacggaaaagctcatccgcgagaaagatgaggaactcaggcgcatgcaggagatgctccataagattcagaagcaaatgaaggaaaactac

SEQ ID NO: 7449 - DNA, 1434 bp, Artificial Sequence
  Description of Artificial Sequence: Synthetic Transcript Sequence
atggatcgctctctgggatggcaggggaactctgtgccagaggacagaaccgaagccggaataaagcgctttcttgaagacacaacggatgacggcgagttgtccaagttcgtcaaagacttttccggcaacgcctcctgccacccgcctgaagcgaagacatgggcatcacggccccaagtgcccgaaccaaggccacaagcccctgacctctatgacgatgacctggaatttagacccccttccagacctcagtctagtgataatcagcagtacttttgtgcaccggccccactgtcaccctccgctcgccccagaagtccatggggaaaactggatccatatgacagcagcgaggacgataaggaatacgtcggcttcgctactttacctaaccaagtgcatcgcaaatcagtgaaaaaaggatttgacttcaccctcatggtggccggtgaatccgggttgggcaaaagcactctggtaaattccctatttctcactgatttatacagagatcgaaaactgctgggagccgaggagagaatcatgcaaaccgtggagattactaagcacgctgtagatatcgaagagaaaggcgtgagactacgtctgaccattgtagacacccctgggtttggcgatgctgtcaataatactgagtgttggaaacccgttgctgagtatattgaccagcagttcgagcaatatttccgcgacgagagcgggctcaaccgcaagaatattcaagataatcgcgttcactgctgtttgtacttcatctcgcccttcggccacggcctgagacctctagatgttgagttcatgaaagcgctgcaccagagggtaaacatcgtgccaattctggctaaggctgacacccttacgccgcctgaggttgaccacaaaaaaagaaagatacgggaggaaattgaacactttggtattaagatctaccaattcccggattgtgattccgatgaggacgaggatttcaaacttcaggaccaggctttaaaggagtcaatacctttcgcagttataggatctaatactgtggtggaggcccgcggacgccgggttagaggtcggctgtatccgtggggtattgtagaggtggaaaatcccggccattgtgacttcgtgaaactgagaaccatgctcgtacggacacacatgcaggatttgaaagatgtcaccagggaaacccattacgaaaactaccgcgcccagtgtatccaaagcatgacacggctggtcgtgaaagagcgcaaccgcaataaactgactagagagtccgggacagacttcccaatacccgcggttcccccaggcaccgatccggagactgaaaagctcattcgggaaaaagatgaagagctgagacggatgcaggagatgttgcacaagatacagaaacagatgaaggaaaactac

SEQ ID NO: 7450 - DNA, 1434 bp, Artificial Sequence
  Description of Artificial Sequence: Synthetic Transcript Sequence
atggatcggagtctgggctggcaagggaacagcgttccagaagatcggactgaagcagggatcaagagatttctcgaggatactactgatgatggagaattgtctaagttcgtcaaggatttctcaggaaacgcgtcctgccatccaccagaagctaaaacctgggccagcaggccccaagtgcctgaaccaaggcctcaggccccagatctgtacgacgatgatctggagtttcgccctccgtcgcggccgcagtcatcagataatcagcagtatttctgcgcaccagcccctctgtccccttcggcccgccctcgctcgccttggggaaagctggatccctacgactccagtgaagatgataaggagtacgtcggatttgctacgcttccaaaccaagtgcaccggaaatcggtcaagaaaggctttgactttaccttgatggttgcaggcgagtcggggcttggaaagtctaccctggtgaattccctttttctcactgacctctacagagacaggaaacttctcggagcagaagaacggattatgcaaaccgttgagatcaccaagcatgcagtcgatattgaagaaaagggagtgaggctccggctcactattgtggacacccccggatttggcgacgcagtgaacaatactgagtgttggaaacccgtggcagaatacatcgatcaacaattcgaacagtatttcagagacgaatccggtcttaacaggaagaacattcaagacaatagagtgcattgttgcctgtacttcatatcgcctttcggccacggacttcgtcctctcgacgtggagtttatgaaagccctgcaccagcgggtgaacatcgtgcctattctggctaaggccgacacccttactccccctgaggtcgatcacaagaagaggaaaattcgtgaggagattgaacatttcgggataaagatataccagtttccggactgtgacagtgatgaggatgaagatttcaagttgcaggatcaagcgcttaaggaatcaatcccatttgcagtaataggtagcaacacggtggtggaggcacgcggccgccgcgtgcgtggtagactttacccgtggggaattgtggaagtggaaaatccaggtcattgtgactttgtcaagctgagaactatgctggtgagaacgcatatgcaggaccttaaagatgtgacccgggagacgcattacgaaaactaccgtgcgcaatgtatccagtccatgaccaggcttgtggtgaaggaacgcaataggaacaagctgacccgagagagcggtaccgattttcctatccccgcagtaccccctgggactgacccggaaaccgagaaactgattcgagaaaaggatgaagaactccgaagaatgcaagagatgcttcacaaaatccaaaagcagatgaaggagaattac

SEQ ID NO: 7451 - DNA, 1434 bp, Artificial Sequence
  Description of Artificial Sequence: Synthetic Transcript Sequence
atggaccgctccctgggatggcaggggaactcggtgcccgaagataggaccgaggccggaatcaagagatttctggaagataccaccgacgatggggaactgtcaaagttcgtgaaggatttcagcggaaacgcctcctgccacccgccggaggcaaagacctgggcctcccggccgcaggttccggagccgaggccacaagccccggacctgtatgacgacgacctcgagtttagaccaccaagccggccacagagcagcgataatcaacaatacttctgcgcaccggctccgttgtcaccttcggctagacctcgcagcccgtggggaaagctggatccatacgacagctcggaagatgacaaagaatacgtgggattcgccactttgccgaaccaggtccatcgcaagtcggtgaaaaagggttttgacttcaccctgatggtcgcgggcgaaagcggccttggaaagagcacccttgtgaacagcctgtttcttaccgacctctaccgcgatcggaaacttctgggggcagaggagcgcataatgcagaccgtggaaatcaccaagcacgccgtggacatcgaggaaaaaggggtgcggctgcgcctgactattgtcgacaccccgggattcggagacgcagtgaataacaccgagtgttggaaacctgtggctgaatacatcgatcagcaatttgagcaatacttccgagatgagtcagggctcaaccgaaagaacatccaagataaccgggtgcactgctgtctctactttatctcaccttttggccacggactgcggccgctggacgtggagttcatgaaggcgctgcatcagagggtgaatatcgtccctattctggcaaaggctgacaccctcactccaccagaagtggaccacaagaagcggaagatccgggaagaaatcgaacacttcgggatcaaaatctatcagttccccgactgcgattccgatgaagatgaggactttaaactgcaggaccaagccctcaaggagtcgatcccatttgccgtcatcggcagcaataccgtggtcgaggcaaggggcaggcgggtgcgcggacgtttgtacccgtggggaatcgtcgaagtggagaatcctggacattgcgatttcgtcaagctgcgcactatgctcgtgcgcacgcacatgcaagatctgaaggatgtgaccagggaaactcattacgaaaactacagagcgcagtgcatccaatcgatgaccagactggtggtgaaggaacgcaatcggaacaaattgacccgcgaatcgggaactgactttccgatcccggcggttccgccgggcactgacccggaaactgagaagttgattcgcgagaaagatgaagaactgagaagaatgcaggagatgcttcataagatccaaaagcagatgaaggaaaactac

SEQ ID NO: 7452 - DNA, 1434 bp, Artificial Sequence
  Description of Artificial Sequence: Synthetic Transcript Sequence
atggatcggtcattaggttggcaaggaaatagtgttcctgaggaccgaacggaggcaggcatcaaacgttttttggaggataccacagacgatggtgagctgagcaaattcgtgaaagacttctcaggaaacgcttcatgccatccacctgaggccaagacatgggcatccagaccgcaggttccggagcctcgtccccaggcgcccgatttgtatgacgatgacctcgagttccgcccaccaagccggccacaatcgtcagacaaccaacagtatttctgtgctcccgcgcccctgtcgccatctgccagaccacgaagcccatggggaaagctggatccttacgattcatccgaagacgacaaggagtacgtgggttttgcaacgctacctaatcaggtacatcgaaaatcggtgaagaagggatttgatttcactctcatggttgctggcgaatcagggctcgggaaatcaacactcgttaactccttgttcctcaccgacctataccgggaccgtaagttactaggagccgaggaacgtattatgcagaccgttgagataactaaacacgcagtagacattgaagaaaaaggagtacgattacgattgacgattgtcgacacccctggattcggtgatgctgttaacaacacagaatgctggaagccggtggctgagtatatcgatcagcaattcgagcaatacttcagggacgaaagcggattgaatcgaaagaatattcaggacaaccgcgtgcactgttgtctctacttcatatccccttttggacatggactgcgcccactcgacgtggaattcatgaaggccctccaccagagggttaatatagttccgatactggcgaaggctgacacgttgacgcccccggaggtggaccacaagaagcgcaagatacgcgaggaaatagagcatttcggaattaaaatttatcagttccccgactgcgattccgatgaagacgaagatttcaagcttcaagatcaagccctgaaagagtcaattccgttcgcagtgattggtagcaacactgtggtcgaggcacgaggccgacgcgtgcggggccggttgtatccgtggggtattgtggaagtcgaaaaccccggccattgtgattttgtaaaactccgaactatgcttgtgcgtactcatatgcaggacttgaaggatgtgactcgagagacccactatgaaaactacagagcccagtgtatccagtcaatgactcgcctcgtagttaaggagcgtaatcgaaataaacttaccagagagtcgggcacggactttccaattccggcagtgcctccgggcacggatcctgagaccgaaaagttgattcgggaaaaagacgaggaacttcgcaggatgcaagagatgttacacaagatccagaaacaaatgaaggaaaactac

SEQ ID NO: 7453 - DNA, 1434 bp, Artificial Sequence
  Description of Artificial Sequence: Synthetic Transcript Sequence
atggatcgatcgctgggatggcagggtaattcggttcccgaagaccggaccgaggccggaattaagcgtttcctggaggatacaacagacgatggcgagctcagtaaatttgtgaaggacttttctggcaacgcctcatgccatccccctgaagccaagacgtgggcctcccggccacaagtgcccgagcccaggccacaggcccccgatctatacgacgacgatttggaatttcgtcctccttccaggccacagtcatctgataaccagcaatatttctgtgctcccgctccactgtcgccttcagccagacctaggtcaccttggggaaagctggatccatatgatagctctgaggacgacaaagaatacgtcggattcgctacactacctaaccaggtccacaggaagtcggtcaaaaagggcttcgactttaccctcatggttgccggtgagagcggcctagggaaatctactctggtgaactctcttttccttactgacctatatcgcgaccgcaaactgcttggggccgaggagcggatcatgcagacggtggaaattaccaagcacgccgtggacattgaagaaaagggcgtccgactacggctgacgattgtagatacgccaggctttggagatgctgtgaacaatacagaatgctggaagccggtggctgagtacatcgatcagcaatttgagcagtactttcgggatgagagcggactgaataggaagaacatccaggataatcgcgttcattgctgtttgtatttcataagtccctttgggcacggattgcggccgctcgatgtggaatttatgaaagccctgcaccagcgggttaacatcgttccaattcttgcaaaagccgacactctgacaccgccggaagtcgaccacaagaagcggaagatcagggaagaaatcgaacacttcggcataaaaatttatcaatttcccgactgcgactctgacgaggatgaggactttaaactccaggatcaagccctgaaagagtcaatccccttcgcagtgatcggtagtaacacagttgtggaggccagggggaggcgcgttagaggtagactttacccctggggcatcgttgaagtggaaaatccgggacattgtgacttcgtcaaactgagaacaatgttggtacgaacacatatgcaggatctgaaagacgttacacgagagacacactacgaaaactaccgggcacagtgcatacagtctatgaccagactggttgtaaaggagagaaatcgaaataaactgacccgagagagtggaacggactttcctattcccgccgtgccccctgggactgacccagagacggagaaactcatcagggagaaagatgaggaactgagacgtatgcaggagatgttgcacaagattcagaaacagatgaaggaaaattat

SEQ ID NO: 7454 - DNA, 1434 bp, Artificial Sequence
  Description of Artificial Sequence: Synthetic Transcript Sequence
atggatcgctcccttgggtggcaggggaattccgttccagaggaccggaccgaggctgggatcaaacggttcctggaagacaccaccgacgatggggaacttagtaaatttgtgaaggatttttcaggcaacgctagttgccacccccccgaggccaaaacatgggcttctcgaccccaagtgcctgagccgaggccccaggctcccgatctgtatgacgatgacctggaatttcggccccctagtcggcctcagtcatccgacaaccagcagtatttttgtgcacccgcccctcttagtccttccgcccggcctaggtccccttggggtaagcttgatccctatgactcttctgaggacgacaaggagtacgtggggtttgccacattgccaaaccaggttcatcggaagtctgtgaaaaagggcttcgatttcactctgatggtcgcgggcgaaagtggtctgggaaagtctacactggtcaactccttgtttctcacagatctctatcgagatagaaaactgctcggcgctgaggagcggatcatgcagacagtggaaattacaaagcatgccgttgatatcgaagagaagggggtccggctgcggctgacaattgtggacactccggggttcggggacgcggtgaacaacacagaatgttggaagcccgttgctgagtatatagatcagcaattcgagcagtactttcgggatgagtccgggcttaaccgtaagaatatacaggacaaccgtgttcactgttgtctgtattttatctcgccctttggacacggtctgaggccactcgacgtggaatttatgaaggcactgcaccagagggtaaacatcgttcccatcctggccaaagcagacaccctcaccccccctgaggtggaccacaagaagcgaaagattcgagaagagattgaacactttggcataaagatttaccagttccctgactgtgactctgacgaggatgaagactttaagcttcaggaccaggccttgaaagagtcaattccttttgcggtcatcggtagcaatacagtggttgaagcaaggggacggagagtccggggcagattgtatccctggggaattgtcgaagtagagaatccgggtcattgtgattttgttaagttgcgcacaatgcttgtacggacgcatatgcaggacctcaaagacgtaactagggagacacactacgagaattatcgggcacagtgcatacagtcaatgacgagattggttgtgaaggagagaaacagaaacaaactaaccagggaatctggtactgactttcccatcccagctgtacccccaggaaccgaccccgaaacagagaagctaataagggaaaaggacgaggagttgaggagaatgcaggagatgctacacaagattcagaagcagatgaaagagaactac

SEQ ID NO: 7455 - DNA, 1434 bp, Artificial Sequence
  Description of Artificial Sequence: Synthetic Transcript Sequence
atggacagatcgctgggctggcagggcaactccgtcccggaagataggactgaggctggaattaagcggtttctggaagatacaactgatgatggtgagctgtctaaatttgtcaaggatttctcaggcaacgcctcctgtcatccgccagaagccaaaacttgggctagtaggccacaggtacctgaaccgagacctcaggcgcccgatctatacgatgatgacctggagtttaggcctccaagtcgcccccagtcatcagacaaccagcagtatttttgcgcaccagccccccttagccccagtgccaggcctcggagcccctggggtaagctggatccttacgatagcagtgaggacgacaaggaatacgttggatttgctacactgccaaaccaagtccaccggaagagcgtcaaaaaaggttttgattttaccctgatggtcgcaggtgaaagcggacttgggaagagcacactagtcaactctctgttcctgaccgacctctatcgggaccgaaaattgttaggagctgaggaaagaataatgcaaacagtggagataaccaagcatgcagtcgatatcgaggagaaaggagtgaggcttcgcctgaccatcgtggataccccagggttcggcgacgcagtgaacaataccgaatgctggaaaccagttgccgaatacattgaccagcagtttgaacagtattttcgggatgaaagcgggctgaatagaaaaaacattcaagataacagagttcactgttgtctgtatttcatttcacccttcggacacggtcttcgcccactggacgtggagtttatgaaagcactccatcagcgagtgaacattgtcccaatcctcgctaaggctgacacacttacacctccagaggtggatcacaagaagcgcaaaataagagaagaaatcgagcattttggcatcaagatctaccagttccccgattgcgatagtgatgaggatgaggacttcaagctccaggatcaagccctgaaagagagcatccctttcgctgtgattgggtccaacactgtggtggaggccaggggaagacgtgtccgcggcagactttacccctggggaatcgtggaagttgagaatccagggcattgtgattttgtgaagttacgaacaatgctggtgaggactcacatgcaagatttaaaggacgtgaccagggagacacattatgaaaactacagggcccaatgcatccagtcaatgacacgattggtggtaaaagagcggaacaggaacaagctcaccagggaatctgggaccgatttccctatccctgccgtccctccaggcacagatccagagaccgaaaaactgatcagagaaaaggatgaagagctccgaagaatgcaagaaatgcttcacaaaatccagaagcaaatgaaggaaaactac

SEQ ID NO: 7456 - DNA, 1434 bp, Artificial Sequence
  Description of Artificial Sequence: Synthetic Transcript Sequence
atggatcgttcacttggatggcaaggaaactccgtgcctgaagatcgcacggaggcaggtatcaagcgcttcctcgaagatactacggacgacggcgagctgtcaaagttcgtaaaagatttctcgggaaacgcctcgtgtcatccacctgaggccaagacgtgggcctcccggccgcaagtccccgaaccccgccctcaggcaccagacctctacgatgatgacctggagtttcggcctccatcgaggccccaaagctccgacaaccagcaatacttttgtgcacccgctccactttcaccgagcgcaagaccacgatcgccttggggcaagttggatccttacgattcgagcgaagatgataaagaatacgtgggctttgccaccctgccaaaccaagtgcacagaaagagcgtgaaaaaaggttttgattttactctgatggtcgcaggagaatcggggctgggaaaatcaactttggtgaattcgttgtttttgaccgatctttatagagatcgcaaactgctgggggccgaggaaagaattatgcaaaccgtcgaaattacgaaacatgcagtcgacattgaagaaaaaggtgtcagactccgtcttacgatcgtcgatactcctggatttggagacgcagtgaacaatacggagtgttggaaaccagtggcggagtacatagatcagcagttcgagcaatactttcgggacgagtccggtctgaacagaaagaatatccaggataatagggtgcactgctgtctttacttcattagcccgttcgggcacggactccgcccgctcgacgtggaattcatgaaggcactgcatcagcgtgtcaacatcgtgcctatcctcgcgaaagcagatactcttactccaccagaagttgatcacaagaagcggaaaatccgggaagaaatagaacattttggaataaagatctatcaattcccagactgcgattcggatgaggatgaagatttcaaactgcaggaccaagcactgaaagaatcgattccattcgcagtgattggttcgaatactgtcgtggaggcgagagggcgtagagtgagaggcagactttacccttggggtatcgtggaagttgagaatccgggccattgcgactttgtgaaacttcggaccatgctggtgaggactcacatgcaagatctgaaggacgtgactcgcgagactcattacgagaactaccgcgcacaatgcattcagagcatgaccagactggtggttaaggaaagaaacaggaataaactcacgcgggagagcgggaccgactttcctattcccgcagttcctcctggaactgacccggagacggaaaagctgatacgggaaaaggatgaagagctgcgacgcatgcaagagatgcttcataagattcaaaagcaaatgaaggagaactac

SEQ ID NO: 7457 - DNA, 1434 bp, Artificial Sequence
  Description of Artificial Sequence: Synthetic Transcript Sequence
atggataggtccctgggctggcagggcaattcggttccagaggacaggaccgaggctggaatcaaacgttttctggaggacaccaccgacgacggtgagctgagcaaattcgtcaaggacttctcggggaatgcgagctgccatccacctgaggcaaagacgtgggcatccagaccccaagtgcctgagcccagacctcaggcaccagatctgtacgatgatgatctcgagtttagacctccctcgaggccccaatctagcgataaccaacagtacttttgtgcacctgcccccctttcgccatctgcacgtccacgatcgccttggggaaaacttgatccctacgacagcagcgaagatgataaggaatacgtcggtttcgccactctccctaaccaagtgcatcggaagtcagtcaagaagggtttcgactttactctgatggtcgcaggggagtcaggactgggaaaatcgacccttgtgaactcactgtttttgaccgatctgtatcgcgatcggaagctgctgggtgcagaggagaggatcatgcaaactgtggagataaccaagcacgccgtggatattgaagaaaagggagtgaggctgagactcaccattgtcgacacccctggttttggcgacgcagtcaacaacaccgaatgttggaaacctgtggcagaatacatcgatcaacaattcgaacaatacttccgcgatgaatcgggccttaatagaaagaatatccaagataaccgcgtgcactgttgtctttacttcatctccccttttggacatggtctgcgccccctggacgtggagtttatgaaggcactccaccaaagggtgaatatcgtgcctattctggccaaggccgacacgctcaccccaccagaggtcgatcacaagaaaagaaagatccgcgaggaaattgagcattttggtatcaagatttaccagttccctgactgcgattcggatgaagatgaagatttcaagttgcaggatcaagccctgaaagaatcgatcccatttgcagtcatcggttcgaataccgtcgtggaagcccgcgggcgccgagtgcggggcaggctgtacccctggggaattgtggaggtggaaaaccctggacattgcgactttgtgaaactcaggactatgttggttaggacgcatatgcaggatctgaaggacgtgactcgtgaaacccactacgagaattaccgagcccagtgtattcagtccatgacccgccttgtagtcaaggaacgcaaccgaaacaaacttaccagagagagcgggaccgatttccctatacccgcagtccctcccggcaccgaccctgaaactgaaaagctgattagagagaaggatgaagagctcagacgaatgcaggagatgctgcataagattcaaaagcagatgaaggagaactac

SEQ ID NO: 7458 - DNA, 1434 bp, Artificial Sequence
  Description of Artificial Sequence: Synthetic Transcript Sequence
atggataggtccctcggatggcagggtaatagcgtccctgaggatcggaccgaagccggaattaagcgctttctcgaagataccaccgacgacggggaacttagcaagtttgtgaaggatttctccggaaacgcaagctgtcatcctccagaagcgaaaacgtgggcttcacgaccacaggtcccggaacccagaccccaagcgccagacctttacgacgatgatcttgagtttaggcctcccagccggccccagagctctgataatcagcaatacttctgcgcacctgctcctctttcgcccagcgctagaccacggagcccatggggaaagctggacccgtacgactcctccgaggatgacaaggagtacgtcgggtttgcgactctcccaaaccaggtgcatagaaagagcgtcaagaaaggctttgattttaccctgatggtggcaggagaatccgggctggggaaaagtacgttggtgaactccctgtttctgactgatctctaccgggatagaaaactcctgggtgcagaagaaagaatcatgcaaactgtggaaatcaccaagcacgctgtggatattgaagaaaagggcgtgagactcaggctgactatcgtggatacccctggatttggcgacgcagtgaacaataccgagtgttggaagcctgtggcagaatacattgaccaacagttcgaacagtattttcgtgatgagtccggtctgaaccggaaaaacatacaagataatagggtccactgttgtctgtatttcatctcaccatttgggcatgggctgaggccactggatgtggaattcatgaaggcgctgcatcagagggtcaatatcgtgcctatacttgcaaaggcagacacgcttacccctcctgaggtggaccataagaaaagaaagatcagagaagaaatcgaacatttcggaattaagatatatcaatttccagactgtgattcggacgaggatgaagatttcaaacttcaagatcaggccctcaaagagtccattccattcgcagtgatcgggtcgaacaccgtggtggaagcacgaggtcgacgggtgagaggacggctttacccttggggaatcgtggaggtggaaaacccaggccattgcgattttgtgaaacttcggaccatgcttgtcagaacccatatgcaggacctgaaggacgtgaccagagaaacccactacgagaattaccgtgcccagtgcatacaatccatgactaggctggtggtgaaagaaagaaacagaaataagctgacgcgagagtcgggtactgattttcctattcccgccgtgccacctggtactgatccagagactgaaaagctcattcgcgaaaaggatgaagaactcagacggatgcaggaaatgttgcacaagatccagaagcagatgaaggagaattac

SEQ ID NO: 7459 - DNA, 1434 bp, Artificial Sequence
  Description of Artificial Sequence: Synthetic Transcript Sequence
atggataggtcactcggatggcaggggaattccgtgcctgaagataggactgaagcaggaataaaaagatttctggaagatacaacagacgatggggagctatctaaattcgtaaaagatttcagtgggaacgcgtcgtgtcacccacctgaagctaaaacttgggcatctcggccacaggtacccgagcccagacctcaggctcccgacctttacgatgatgatctcgaattcaggccaccctcgcggcctcagtcttccgataatcagcagtatttttgcgcccccgccccactctcacctagtgccaggcctagatctccatggggaaaactggatccctacgattcctctgaagatgataaagaatacgtggggttcgctacactacccaaccaggtgcaccgaaagtccgtcaaaaaaggatttgactttacacttatggtcgcaggagaatcggggctcggaaaatctactctagtaaacagtttattcctcacagatctttatcgggatcgaaaactgctgggagctgaagaaagaatcatgcagacagtggaaataacaaaacatgccgttgacattgaagaaaagggagtacggctgcgactcactattgttgacactccaggatttggggatgctgtgaataatactgagtgttggaaaccagtcgccgaatatatcgaccagcagttcgaacagtatttccgtgatgaatctggacttaaccgcaaaaatatacaagataatagagtgcactgttgcctatacttcatctcccccttcgggcatgggctaagaccccttgatgtggaattcatgaaagctctacaccagcgggtcaatattgttcccatattggccaaagctgatacacttactccacctgaagtggaccacaaaaaaaggaagatccgggaggaaatagaacattttggaataaaaatttatcagtttccagattgtgactccgatgaagatgaagatttcaaactccaagaccaagctctcaaagaatcaatcccattcgccgttatagggagtaatactgtcgtggaagctcgggggcgccgggtgaggggaagactgtacccctgggggatagtagaagtggaaaaccccgggcattgtgatttcgtcaaacttaggacaatgctggtgcgcacacacatgcaagatttgaaagacgtgacaagggaaactcattatgaaaattatagggctcagtgtatccagtctatgacaagactggttgtgaaagaacgaaataggaacaaactcacacgagaatccggaacagatttcccaattcctgccgtgccccccggaacagatccagaaacagaaaaattgatacgcgaaaaggatgaagaattaagaagaatgcaggaaatgctccataaaattcagaaacagatgaaggaaaattat

SEQ ID NO: 7460 - DNA, 1434 bp, Artificial Sequence
  Description of Artificial Sequence: Synthetic Transcript Sequence
atggaccggagtcttggctggcaggggaatagcgtacctgaagacaggacagaggcaggcataaagagattcctcgaagatactactgacgacggtgaactgtctaaattcgtcaaagatttcagtggaaacgctagctgccacccgccggaggctaaaacatgggccagcaggccacaggtccccgagcctcgaccacaagccccagacttgtacgatgatgaccttgagtttaggcctccttctaggccacagtctagcgataatcaacagtatttctgcgcaccagctcccctgtcccctagcgcgcgcccccggtcaccatggggtaagctggatccttacgatagctctgaggacgacaaggagtacgtgggtttcgctaccctaccaaatcaagtgcaccgcaaatccgtcaaaaaaggctttgattttacactgatggttgctggcgaaagtgggcttgggaagtctaccctggtcaactcactcttcctgacagatctgtatagagatcgcaaacttcttggagcagaggaacgcattatgcagactgtcgaaatcaccaaacacgccgtagacattgaagagaaaggcgttaggcttaggctgaccatcgtggatacaccgggctttggagatgctgtgaacaacactgagtgttggaaacctgtcgcagaatacatagatcagcagttcgagcaatactttagggatgagtctggattgaaccgaaaaaacatccaggacaatagagtacattgctgtttgtactttatcagccctttcggccacggtctcaggcccctggacgtggagttcatgaaggctctccaccaaagagttaatatcgtacctatcttggcaaaggcagatacattaacccccccagaggttgaccacaaaaaaaggaagatcagagaagagattgaacactttggtatcaagatctatcaatttcctgattgcgactctgacgaggacgaagattttaagcttcaggaccaggctctaaaagaatcaattccctttgccgtcatcggcagtaacacagtagttgaggccagaggtcgcagggtcagggggcggctgtatccatggggcatcgtcgaggttgagaaccctggacattgcgatttcgtgaaactaagaacgatgctggttcgcacccatatgcaagatttgaaagatgtcacgcgggagacccattacgaaaactatagggctcagtgcatacaatctatgactagactggtcgtgaaggagagaaacagaaataaactgactcgggagtctggcaccgatttcccgattcctgcagtgccgcccggtactgacccagagacagaaaaacttatccgcgagaaggatgaagaactcaggaggatgcaagagatgctgcacaagattcaaaaacaaatgaaagaaaactac

SEQ ID NO: 7461 - DNA, 1434 bp, Artificial Sequence
  Description of Artificial Sequence: Synthetic Transcript Sequence
atggacagaagtttaggctggcaaggaaatagtgtcccagaagatagaacggaggctggaataaagcgtttcctcgaagatacgactgatgatggagaattgagtaagtttgttaaggatttctctggtaatgcgagctgccatccaccagaagctaagacatgggcttcaagaccacaagtgccggaaccacgcccccaggctccagatctctacgatgacgaccttgagtttcgcccaccatccagaccacaatcttctgataaccagcaatatttctgtgcaccagcaccactttctcctagtgcacgcccgcgatcaccatggggtaagctggatccatacgattcatccgaagatgacaaggagtatgtcggattcgctacgttaccgaatcaagtacaccgaaagagtgttaagaaaggttttgatttcactttgatggtcgccggcgaatcaggacttggtaaaagcacactggtaaatagtctattccttactgatttataccgtgatagaaaacttctcggagcagaagaaagaatcatgcaaactgtggaaataacaaaacatgccgtagatattgaagaaaaaggtgtccgcttgcgattaacaatcgtagataccccaggttttggagatgcagttaacaatacagaatgctggaaaccagtcgccgaatatattgatcaacaatttgagcaatattttcgcgatgaatccggacttaaccgtaagaatattcaagataatagagtacattgctgtttgtatttcatctctcccttcggtcatggattgcgaccacttgatgttgaattcatgaaggcactgcaccaaagggtgaatattgttccgatccttgccaaggctgacacattaacaccgccagaggtcgaccataagaaacgaaaaatacgagaagaaatcgagcatttcggaattaaaatataccaatttccggattgcgatagcgatgaggatgaggattttaagcttcaggaccaggctttaaaggaatcgattccttttgctgtgattggatccaatacggttgtagaagcacgggggcgacgagtgcgcggaagactttatccctggggtatcgtagaagttgaaaatcctggacattgtgatttcgtgaaactccgtacaatgttggtccgaacccatatgcaagatctcaaagatgtaactcgggagactcattatgaaaattatcgagcccaatgtattcagtcaatgaccaggttggtcgttaaggaacgcaatagaaataaactcaccagagagtcgggaacggacttccctatcccggccgttccaccgggtacagatcctgaaacggagaaattaattagagagaaagatgaggaattacgcagaatgcaagagatgcttcacaagattcagaagcaaatgaaagaaaattat

SEQ ID NO: 7462 - DNA, 1434 bp, Artificial Sequence
  Description of Artificial Sequence: Synthetic Transcript Sequence
atggatcgctccctgggatggcaaggtaacagcgtgccggaggacagaaccgaggccggaatcaagcggttcctggaagacactaccgacgacggagaactgtccaaattcgttaaggacttctcgggaaacgccagctgtcacccgccggaagccaagacctgggcttcaaggccgcaagtgccggaaccgaggcctcaggccccggatctgtacgacgacgaccttgagtttagaccaccgtcacggccgcaatcatccgataaccagcagtacttctgcgctccggcgcctctgtcaccctcagcgcgcccgcggtcgccatggggaaagctcgacccgtacgattcgtctgaggacgataaagagtacgtgggcttcgcaaccctgccaaatcaagtccatcgcaagagcgtgaagaagggattcgattttactctgatggtggcaggagagtctggactcggaaagtccacgctcgtcaattcattgttccttactgacttgtaccgggaccggaagttgctcggtgccgaggaacgcatcatgcaaaccgtcgagattaccaaacacgcagtggacatcgaagagaagggagttagactgcggctgactattgtggacacccccggtttcggcgatgctgtcaacaatactgaatgctggaagccggtggcggagtacatcgaccaacaattcgagcagtattttagagacgaatcgggccttaatcgtaagaacatccaggataaccgggtgcactgttgcctgtacttcatcagcccgttcggccatggtcttaggccgctggacgtggaatttatgaaggccctgcaccagagagtcaatatcgtgccgatactggcgaaagctgacaccctgactccgccggaggtggaccataagaaaagaaagattcgcgaagagatcgaacacttcggaatcaaaatctaccaatttccagactgtgactctgatgaggacgaggactttaagttgcaagatcaggctctcaaggaatccatccccttcgccgtcatcggatcgaacacggtcgtcgaagcgagaggccgccgcgtgcgaggaagactgtacccgtggggaattgtggaagtggagaatccaggccactgcgatttcgtgaaacttaggactatgctcgtccgcactcacatgcaggacctcaaggacgtcaccagggaaactcactacgaaaactaccgcgcccaatgcatccaatcaatgacccggctggtcgtgaaggagagaaacagaaacaagctgactagggaatccggcaccgacttcccaatccctgcggtgccgcctggaaccgacccggagacggaaaagctgatcagagaaaaggacgaggaactccgaaggatgcaggaaatgctccacaagattcagaagcagatgaaggagaactac

SEQ ID NO: 7463 - DNA, 1434 bp, Artificial Sequence
  Description of Artificial Sequence: Synthetic Transcript Sequence
atggatcgcagtttagggtggcagggaaactccgtgcccgaagatcgcactgaggcagggatcaaacggttcctggaagatacaactgacgatggagaactatccaaattcgtgaaagatttcagtgggaatgcatcatgccacccccccgaggctaaaacttgggcctcacggcctcaggtgcctgaaccacggccacaggcccccgatctttatgatgatgatcttgaatttagacctccttcaagacctcagtcctccgataaccaacagtacttctgtgctcccgcccccctgtctccatctgcgaggcctcgaagtccctgggggaaactcgatccatatgattcttccgaagatgataaagagtatgtgggattcgccactttgcctaatcaggtgcacaggaaaagtgtaaaaaaagggttcgactttacactgatggtggccggggagtctggactgggaaaaagtacactcgtgaactctttattcctgacagacctatacagggacaggaaactacttggagccgaagaacggattatgcagactgtggaaataactaaacatgccgtcgatatcgaggagaaaggagtacgcctcagactgacaatagtggacactccaggattcggagatgcagtgaataatactgaatgctggaaaccagtagcagaatacatagatcagcagtttgaacagtatttcagagatgaatcggggctcaacaggaaaaatatacaggacaatcgcgtgcattgctgtctctatttcatctctccattcggacatggactgcggcccctggatgtcgaattcatgaaagccctgcatcaaagggtaaatatagtcccaattcttgctaaagcagatactctgacaccaccagaagtcgatcacaaaaaaagaaaaatacgggaagaaattgaacacttcggaataaaaatttaccagtttccagattgtgattccgatgaggacgaggatttcaaactccaggatcaggctttaaaagaatctatacccttcgctgtgataggaagtaacacagtggttgaagcacgcggaagacgagtgcgagggcgactgtatccatgggggattgtagaagtagaaaaccctggacattgtgattttgtcaaattaaggactatgttagtacgaactcatatgcaggatctgaaagatgtgacacgagaaactcattatgagaattacagggcccaatgcatacagtctatgacaaggctcgtagtgaaagagcggaaccgaaacaaattaactcgagaatctgggacagatttcccaatccctgccgttcctcctgggactgatcccgaaacagaaaaactgatccgggaaaaagacgaagaacttcggcgtatgcaggaaatgctgcacaaaatacaaaaacagatgaaggagaattat

SEQ ID NO: 7464 - DNA, 1434 bp, Artificial Sequence
  Description of Artificial Sequence: Synthetic Transcript Sequence
atggatcgaagtcttggatggcagggcaactctgtgccagaagatcgcactgaggccggaattaagcggttcctggaggacaccaccgatgacggagagttgtccaagttcgtcaaggacttcagcgggaacgcatcctgccatccgcccgaggctaagacgtgggcatcaagaccgcaggtgccggaacctcgtccacaggcgccagacttgtatgatgacgacctcgaatttcgtccaccgtcaaggccgcaatcatcggacaatcagcagtatttctgcgctccggccccactctcaccgtcggccaggcctagaagcccgtggggaaagctggatccttacgactcatccgaagatgataaagaatacgtcggatttgctaccctgccgaaccaggtacaccgcaagtccgtgaagaagggatttgacttcactctgatggtggccggggagtccggtcttggtaagtcgaccctggttaactccctctttctgactgatctttaccgcgacaggaaactcctcggggccgaggaacgaatcatgcaaaccgtggaaatcacgaagcatgcggtggacatcgaagagaagggcgtgcgcctccggctgaccattgttgatactccaggattcggagacgctgtgaacaataccgaatgctggaagcccgtcgcagagtacatcgatcagcagttcgaacagtacttcagagacgaatcgggtctgaacagaaagaatattcaagacaaccgcgtgcactgttgcctctacttcatctcgcctttcggccatggacttcgccccctcgacgtagaattcatgaaagcacttcatcagcgcgtgaatatagtgccgatcctggccaaagcggacaccctcactccaccggaagtcgaccacaaaaagcgaaagatccgggaagaaatcgagcattttggcatcaaaatctaccagtttcccgattgcgactccgacgaggatgaggatttcaagctgcaggaccaagccctgaaggaatctatcccattcgcagtgatcgggtccaatactgtcgtcgaagcgcggggccgtcgggtgcgcggccgcctgtacccttggggaatcgtcgaggtggagaacccgggacactgtgacttcgttaagctgcggaccatgcttgtgcgcactcacatgcaggacctgaaggatgtaactcgcgagacgcactacgagaactaccgtgcccaatgcatccaaagcatgacccgcctggtcgtgaaggaacggaacaggaacaaactgactagagaatctggcaccgatttccctatccccgcggtgccacctgggactgatccggaaaccgagaaattgatccgggaaaaagatgaggaactgcgccggatgcaagagatgttgcacaagattcaaaaacaaatgaaggagaattac

SEQ ID NO: 7465 - DNA, 1434 bp, Artificial Sequence
  Description of Artificial Sequence: Synthetic Transcript Sequence
atggataggtctttgggatggcagggtaacagcgtgccggaggacaggactgaggccgggatcaaacggttccttgaggatacaacagatgatggggagttgtctaaattcgtcaaggactttagtggtaatgcaagctgtcaccccccagaggcaaaaacctgggcttcacggcctcaggttcctgagccaagacctcaggctcccgacctgtatgatgacgatctggaattccgaccgccatctaggccacagagctcagataaccagcagtacttttgcgctcctgctccactctcaccaagcgcccgaccccggtccccttggggcaaactggacccttacgattcttctgaggatgataaagagtacgtcgggttcgctacccttcctaatcaggtacaccgaaagtccgtgaagaagggattcgacttcaccctcatggtcgccggggagagcggtctcggaaaatctactttggtcaattccctgttcctgactgacctttacagagacagaaaactgctgggcgctgaggaaaggatcatgcagacagtggaaataaccaagcacgccgtggacatagaggaaaagggtgttaggctgcgcctgactatcgtagacactccagggttcggagatgcggtgaacaataccgagtgctggaagcccgttgctgaatacatcgaccaacagttcgaacagtactttcgcgatgaatctggattgaatcggaagaacatacaggataaccgagtccactgttgcctgtatttcatttcccctttcggccacggcctgcgccctctggatgtggaattcatgaaggccctgcaccagcgggtcaacattgtgcctattttggccaaggccgacacacttactccgccagaggtggatcacaaaaaacgcaaaatccgggaggagattgaacattttggtatcaagatttaccagtttccggactgcgactccgatgaggatgaggacttcaagttgcaggaccaggcccttaaagaatcaatcccttttgctgttattggatctaataccgtggtagaggctagagggcggcgagtgagggggcggctttacccttggggaattgtggaggtcgaaaacccggggcactgcgattttgtgaaactgaggacgatgctggttagaactcacatgcaagaccttaaggatgtgaccagagaaacacactacgaaaactacagggctcagtgtattcaaagtatgacccggcttgtggttaaggaacgcaataggaacaagctcacacgggaatcaggaacagatttccctatccccgccgtgccgccaggtacagacccagagacggagaagttgattcgggagaaagacgaggaactgcggaggatgcaagaaatgttgcataaaattcagaagcagatgaaagaaaactac

SEQ ID NO: 7466 - DNA, 1434 bp, Artificial Sequence
  Description of Artificial Sequence: Synthetic Transcript Sequence
atggatcgctcattgggctggcagggtaactcggtgcctgaggacaggactgaagccggtatcaagaggttcctggaagataccaccgacgatggtgagctgagcaaatttgtgaaggactttagcggcaacgcatcctgccacccgcctgaagctaagacctgggcttcgcggccgcaggtgcccgaacctcgcccgcaagcgccggacctctacgatgacgatctggaattccgccctccgtcgcgccctcagagctcagacaaccagcaatacttctgcgccccggcaccgttgtcgccttctgcccgtccacggtccccgtgggggaagctggatccgtacgactcgtcagaggatgataaggagtacgtgggatttgctacccttccgaaccaggtccatcgcaagagcgtgaagaagggctttgatttcaccctgatggtggctggagagtctggactgggaaagagcactctcgtgaattcgctcttcttgacggatttgtatagagatcggaagctgctgggcgcggaagagagaatcatgcagaccgtggagatcactaaacacgccgtggacattgaagagaagggagtgcgactccgcttgacgattgtggacactcctggtttcggagatgctgtgaacaacacggaatgctggaaaccggttgcggagtacatcgatcaacagttcgaacagtacttccgcgacgagtcgggactgaatcgcaagaacatacaggataacagagtgcactgctgcctgtactttatctcaccattcggccacggcctgcggccactggacgtcgaattcatgaaggcccttcaccagagagtcaacatcgtgcctattctcgccaaggcagataccctcaccccgcccgaggtcgaccacaaaaagcgcaagatccgcgaagagatcgaacactttggtatcaaaatctaccagttcccggattgtgactctgatgaggacgaggacttcaagctccaggaccaggcactcaaggaatcgatccctttcgccgtgatcggatcaaataccgtggtggaagcacggggcaggcgggtgcggggcaggctctacccatgggggatcgtggaagtcgaaaatccgggtcactgcgacttcgtgaagctgcgcactatgcttgtcaggactcatatgcaggatctgaaagacgtgacccgggaaacgcactacgaaaactacagagctcaatgtatccagtcaatgactcggctggttgtgaaagaaaggaatcgcaacaaattgacccgtgaatccggcactgatttcccgatcccagccgtccctcccggaactgatcccgaaactgagaagctgatcagagagaaagatgaggagctgcgcagaatgcaggaaatgctgcacaagatccagaagcaaatgaaagaaaactac

SEQ ID NO: 7467 - DNA, 1434 bp, Artificial Sequence
  Description of Artificial Sequence: Synthetic Transcript Sequence
atggatcgaagcttgggctggcagggaaactccgtgcccgaggaccggaccgaggccggcataaaaaggttcctcgaagacactacagacgacggggagttatccaaatttgtgaaagatttttctggtaatgcctcctgtcatcctcccgaagccaagacctgggcatctcgccctcaggtcccggagcctcggccccaagcccccgatttgtacgatgacgatctggagttcagacctccgtccagaccccagtcaagcgacaaccagcagtacttttgtgcaccagcaccattgagtccgtcagcacgtcctcgctccccatggggaaaactagacccttacgatagtagcgaagacgataaggagtatgtgggcttcgccacgctgccaaatcaagtccaccgtaagtcagttaagaagggattcgattttacactcatggttgcgggtgaatcgggattggggaagtccaccctcgtcaattccctctttctgactgacctgtatcgcgacagaaaacttctcggtgccgaggagagaatcatgcagactgtggaaatcacaaagcatgctgtggatatcgaggagaagggggtgagattgcggctcaccatcgtggatacgcccgggttcggagatgctgttaataacactgaatgttggaagcctgtcgctgagtatatcgatcagcagttcgagcagtactttagggatgaaagcgggctgaatcggaaaaacattcaggataatcgcgtgcactgctgtctttactttatttctcctttcggtcatggactgcgtccactggacgtagagtttatgaaagccctgcaccagagggtaaacattgttcccatattggcaaaggcggacacattaacccctccggaggtggaccataaaaagaggaagatcagagaggaaatagagcattttggcattaagatctaccaatttccagactgcgacagcgacgaggatgaggattttaaactccaggaccaagcccttaaagaatccataccatttgctgtcatcggtagcaatacagttgtggaagcccgcggaagaagagtgcgcggtcgactgtacccatggggcatcgtggaagtcgagaatccgggacactgcgattttgtgaagctgaggacgatgctcgtgcgaacccacatgcaggatcttaaggatgttacgcgcgagacgcattacgagaactacagggctcagtgcatccagagcatgaccagactggttgtaaaggaacgaaacagaaacaaactcacgcgtgagagcggaactgatttccccattcccgcagtccccccaggcaccgaccctgagacggaaaagctgatccgtgagaaggatgaagagctccgcagaatgcaggagatgcttcacaagatacaaaagcagatgaaagagaactat

SEQ ID NO: 7468 - DNA, 1434 bp, Artificial Sequence
  Description of Artificial Sequence: Synthetic Transcript Sequence
atggaccggtccctcggctggcagggcaacagtgttccagaggaccggacagaggctggaatcaaacggttcctggaggataccactgacgatggggagctttccaagttcgtgaaggacttctcggggaatgcgtcctgccacccacctgaagctaagacttgggcttccaggccgcaggtgccagaaccgagaccacaagccccggacttgtacgacgacgatctggagttccgacctccttcacgtccacagtcctcagacaatcagcagtatttctgtgccccggctcccctgagtccatctgctagaccacgcagtccatggggaaagctggatccctatgacagttccgaagatgacaaggagtatgttgggttcgccaccctgccgaatcaagtccataggaagtcggtgaaaaagggcttcgattttaccttgatggtcgcaggagagagtggcctggggaaatcaacccttgtgaattcattattcctcactgatttataccgcgatcgtaaactcttaggagcagaagaaagaattatgcagacagtggaaataaccaaacacgccgtcgatatcgaagagaagggcgtgcgcctgaggctgaccatagttgacacccctgggttcggtgatgccgtaaacaataccgagtgctggaagcccgttgccgagtacatagatcaacaatttgagcaatacttccgagacgagtctggactgaacagaaaaaacattcaggacaatcgagtacactgctgtctttactttatctcccctttcggtcacgggctgcgcccactggatgtagaatttatgaaagccctgcaccagcgggttaatatagttcctattcttgcaaaagccgacaccttgaccccaccagaggtagatcataagaagaggaaaatcagagaagagatcgagcattttgggatcaagatttaccagttcccagactgtgatagtgatgaggacgaagacttcaagctccaggaccaagccctcaaagagtctatcccgttcgctgtaattggttcaaacacagtcgttgaggctcgtggtcgtcgggttcggggccgtctctacccctgggggattgtggaggtcgagaatccaggccactgtgacttcgtgaagctgcggactatgcttgtccggacccacatgcaagatctcaaagacgtgacacgcgagacccactatgagaattaccgcgcacaatgcatccagagcatgactagactagtggtaaaggagcgcaatcgtaacaagttgacccgagagagcggaactgatttcccaatcccggcggtacctccgggcactgaccccgaaacagaaaagctcatccgggagaaggacgaggaactgaggaggatgcaggagatgttgcataaaatccagaagcagatgaaagaaaattac

SEQ ID NO: 7469 - DNA, 1434 bp, Artificial Sequence
  Description of Artificial Sequence: Synthetic Transcript Sequence
atggacaggagcctcggatggcaggggaactcggtgccggaagatcgcacggaggcaggcatcaagcggtttctggaagataccactgacgatggggagctgtccaagtttgtgaaggatttctcaggtaacgcctcttgccaccctccggaggccaagacatgggcttctcggcctcaggtgccagaaccaagacctcaagcacccgatttatacgacgatgacttggagtttcgaccaccatcaaggccccagagtagtgataaccaacagtatttttgcgccccagctcccctaagccccagcgcgagaccccgatctccctggggcaagctggacccctatgacagcagtgaagacgacaaagaatacgtgggtttcgctacgctgccgaatcaagtgcatcgcaaatctgtcaagaaggggtttgacttcaccttgatggtagccggtgagtcagggcttggtaagagtaccctcgtgaactccttgttcttgaccgatctgtatcgggaccggaaactgctgggtgcggaggagaggattatgcagacagtggaaattactaaacacgctgtggatattgaagagaagggagtgaggctgcggcttactattgtggatacccccggctttggggacgccgtgaacaataccgagtgctggaagcctgtggcagagtatatagaccaacagtttgaacaatacttccgagatgaaagcggtctgaatcgcaagaacatccaagacaaccgcgtccattgttgcctgtattttatcagtccgttcggacacgggttgagacctctggatgtggagttcatgaaagccctccaccagagggtcaacatcgtccctattctcgccaaggccgataccctgacaccccctgaagtggatcacaaaaaacggaaaatacgcgaagagatcgagcacttcggcatcaagatatatcagttcccggactgtgattccgacgaggacgaggactttaaattacaggaccaggcgcttaaggaatctatcccttttgctgtgatcggatcgaatacggttgtggaggctcgaggccgcagggtaaggggcagactctatccctggggcatcgtagaggttgaaaatcccgggcactgcgacttcgtgaaactgagaactatgctcgtgaggacacacatgcaagatttaaaggacgtcaccagagaaacccactatgaaaattaccgggcacaatgcatacaaagtatgacgaggcttgtggttaaggagaggaaccgcaacaaactgacgcgggaaagtggtaccgactttcctatccctgctgttccgcccggcacggatccggaaactgaaaagctgattcgcgaaaaggacgaggagctccggaggatgcaggaaatgttgcacaagatccagaaacagatgaaagagaattac

SEQ ID NO: 7470 - DNA, 1434 bp, Artificial Sequence
  Description of Artificial Sequence: Synthetic Transcript Sequence
atggacaggtcattgggctggcaaggaaatagtgtgcccgaagatcgtaccgaagcaggtattaagcgcttcctggaggacactactgacgatggcgaactgagtaagttcgttaaggacttctcgggcaatgcctcctgccatcctcctgaagccaaaacctgggccagtaggccccaagtcccagaaccacggccccaggctcctgatttatatgacgacgacctggagtttcggcccccaagtcggccgcagtcttccgataaccagcagtacttctgtgcacccgcccctttgagcccatcagcaagacctcgatctccctggggaaaactggacccctatgatagcagtgaggatgacaaggagtatgtgggcttcgctactctgcccaatcaggtgcatcgtaagtcggtgaagaaagggttcgactttacacttatggtcgctggggaaagcggactggggaagagtactctggtgaattccctattcttgacagacctgtatcgcgaccggaagctgctgggcgctgaagagagaatcatgcagacagtggagatcaccaagcatgcagtggatatcgaggagaaaggggtaagacttcggttgacgattgtggacacgccagggttcggcgatgccgtgaataatacagagtgttggaaacccgtagcggaatacatcgaccagcagtttgaacagtatttccgagatgagtccggactcaatcgcaaaaacatccaggataaccgcgtgcactgctgcttgtactttatcagtccctttggtcatggattgagacctctcgatgtcgagtttatgaaggccctgcatcagcgtgtgaacattgtgcccattcttgccaaggccgatacccttactcccccagaggtggatcataagaagagaaaaattcgcgaggagattgagcacttcgggatcaaaatctaccagttcccggactgtgactcagacgaggacgaggatttcaagttacaagaccaagccctaaaagaaagcatcccattcgcggtaattggtagcaacaccgtggtggaagcccgcggacgtagggtcagagggcgcctatacccctggggaattgtagaggtcgagaatccaggccattgcgacttcgttaagcttcgcactatgttggtgcgtacccatatgcaggatcttaaggatgttacacgtgaaactcactatgagaattaccgcgctcagtgtatccagagcatgacaaggctggtcgtgaaggagcgcaacaggaataaattgacacgggagtctggtacagatttcccgatcccagctgtgcccccaggcaccgatccagagactgaaaaattgattcgggaaaaggacgaagagctgaggcggatgcaggaaatgctccacaagatacaaaaacagatgaaagaaaactac

SEQ ID NO: 7471 - DNA, 1434 bp, Artificial Sequence
  Description of Artificial Sequence: Synthetic Transcript Sequence
atggacaggagccttggttggcagggaaacagtgtgccagaagacagaacagaagctggaattaagcgttttctcgaagatacaaccgacgatggtgagcttagcaagttcgtcaaagacttcagcggtaatgcaagttgccacccaccagaggctaagacttgggccagccgccctcaggtacccgaaccacgtcctcaggctccagatctctacgatgatgacctggagtttcgtccacctagccgccctcagtcctcagacaaccagcaatatttctgtgcccctgcaccattgagcccatccgcacgtccacgctccccctggggtaaactggacccctatgacagtagcgaggacgacaaagaatatgttggcttcgcaaccctgcccaaccaagtccataggaaatcagttaaaaagggattcgattttaccctgatggtggccggtgagtccggcctgggcaagagcacccttgtaaactctctttttctcactgatctctaccgtgatagaaaactcctcggagcagaggaacgcattatgcaaacagtggagattacaaaacacgccgtggacattgaggagaagggtgtccgcctgcgcctgaccatagtcgatacacccggatttggtgatgctgtcaacaacactgagtgttggaagcctgtggctgagtacattgatcaacagttcgaacaatatttccgtgatgagtctggtctgaacaggaagaacatccaagacaacagagtccattgttgcctgtattttatcagccccttcggacacggcttgaggccactggatgttgagttcatgaaagctctccatcagagagtaaatatcgttcctattttggctaaagctgatacattgaccccccccgaggtcgatcacaagaagcgtaagatacgtgaggaaatcgagcacttcggaattaagatttaccagtttcccgattgcgactctgacgaggatgaggatttcaagctccaggaccaggctctcaaggaatctatccccttcgctgtcattggcagtaataccgtggtcgaagctagaggacgccgcgtccgcggccgcctttacccatggggtattgtggaggtagaaaaccccggacactgcgactttgtgaaactgaggactatgttggtgaggacccatatgcaggacctcaaagacgtcacccgcgagacacactatgagaactatcgcgcacaatgcatacagtctatgacaagactggttgtgaaggaacgtaatagaaataaattgacccgcgaatccggaacagacttccctatacccgcagtgcctccaggtaccgatccagagactgaaaagctgatcagggagaaagacgaggagctgaggaggatgcaagaaatgctgcataaaatacagaagcagatgaaggagaattac

SEQ ID NO: 7472 - DNA, 1434 bp, Artificial Sequence
  Description of Artificial Sequence: Synthetic Transcript Sequence
atggacaggtcccttggatggcaaggcaatagcgtgccggaagatagaaccgaagcaggtataaagagatttctggaagataccactgatgatggcgaactttccaaatttgtgaaggacttttcggggaacgcatcctgtcatccgccagaggcaaagacttgggctagtagacctcaagtgcctgagccgcgtcctcaggcaccagacctctacgacgacgaccttgagtttaggccacctagccggccacaatcatccgataatcaacaatacttttgtgccccagcaccccttagcccttccgctcgcccaagatccccatgggggaaacttgatccctacgattcgtcagaggacgacaaggaatacgtcggatttgctaccctgcctaaccaagtgcatagaaaatccgtgaaaaagggttttgactttactctgatggtcgcaggagaatcgggtcttggcaagagcacgctcgtcaattccctttttctgaccgacctttaccgggataggaagctgctgggtgctgaggaaagaatcatgcaaaccgtcgaaattaccaagcacgccgtcgacattgaagagaagggtgtgcgactccgactcaccattgtggataccccaggattcggagacgcagtgaacaacactgaatgctggaagcctgtggcagaatacattgatcagcaattcgaacagtactttagagacgagtcaggactcaacaggaagaatatacaggataaccgcgtgcactgttgtctgtactttatctccccatttgggcacggcctgaggcccctggatgtggagttcatgaaagcacttcaccaacgagtgaacatcgtgccaattctcgcaaaggctgacactcttactcctcctgaagtcgaccataagaagcgcaaaattcgggaagagattgagcatttcggaataaagatttaccaatttccggattgcgattcagatgaggatgaggactttaaactccaagatcaggcactgaaagaatccattcccttcgcagtgatcggatcgaataccgtcgtcgaagcgcgcgggagacgcgtgcgaggacggctgtacccctggggcattgtcgaggtggaaaaccccggccattgcgactttgtcaaactgcgaactatgctggtccgtacccatatgcaagatctgaaggatgttactagggagactcattacgagaattacagggcacaatgtatacaatctatgactcggcttgtggtgaaggaaaggaaccgtaacaaactgacccgtgagagcggcactgactttccaataccagccgtgccacctggaaccgatccagagactgagaaactgatcagagaaaaggatgaagagcttcgtagaatgcaggaaatgctgcataagatacagaagcaaatgaaggaaaactac

SEQ ID NO: 7473 - DNA, 1434 bp, Artificial Sequence
  Description of Artificial Sequence: Synthetic Transcript Sequence
atggaccgctcgttgggatggcagggaaattcagtgccagaggaccgcactgaagctggcatcaaacgcttcttggaggatactaccgatgatggagagctgtcaaagtttgtgaaagacttctcgggtaacgcttcctgccaccccccggaagccaagacttgggccagccgcccacaggtcccggaaccaagaccacaggcccctgacctttacgatgatgatctggaattccgacctccgagcagaccacagagctcggataaccagcagtacttttgtgcgccggcacccctgtcaccgtcagctagaccacgcagcccgtggggaaagctggatccctacgattcgagcgaggatgacaaggagtacgtgggatttgccaccctcccgaatcaggtgcacaggaagtcggtcaagaagggattcgacttcaccctgatggtggccggagaaagcgggctggggaaatcgactctggtcaactcgctgtttctcactgacctctaccgcgatcgcaaactgctgggagcggaagaaagaatcatgcaaaccgtcgaaatcacgaagcatgccgtggatatcgaagaaaagggtgtcaggctgcggcttaccatcgtggacaccccgggatttggcgacgccgtgaacaatactgagtgctggaagcctgtggctgagtacatcgatcaacagttcgaacaatactttcgggacgagtcgggcctgaacagaaagaatatccaagacaatcgggtgcactgctgcctctactttatctcgccctttgggcatggactgcgcccgttggatgtggagtttatgaaggctctgcatcagcgcgtgaacattgtgcccattctcgcgaaggccgacacccttaccccacctgaggtggaccataagaagcgaaagatcagggaggagatcgaacacttcggaatcaaaatctaccagttcccggactgcgattccgacgaggacgaggacttcaagctgcaggatcaggcactgaaggaatctatcccgttcgcagtgatcggctcgaacaccgtcgtggaagcacgcgggcggagggtgcggggccggctgtacccctggggaatcgtggaggtggagaacccgggacactgcgactttgtgaaactccgtaccatgctggtccggacccacatgcaggatctgaaagatgtgacccgcgaaactcattacgaaaactaccgcgctcagtgcattcagtccatgacgcggctggtggttaaagaaagaaatcgcaacaaactcacccgggagtcaggcactgattttccgattcccgccgtgcctccaggtactgatccagagacggagaagctgatccgcgaaaaggacgaagagttgcggcggatgcaggagatgctgcacaagatccagaaacaaatgaaggaaaactac

SEQ ID NO: 7474 - DNA, 1434 bp, Artificial Sequence
  Description of Artificial Sequence: Synthetic Transcript Sequence
atggatcgttcccttgggtggcagggaaatagtgtgcctgaagaccgaacagaggccgggatcaaacgattccttgaggacacgacagatgacggggaactgtctaaatttgtcaaggacttctcagggaatgcatcctgccaccccccagaggccaagacatgggcttcaaggccccaggtgcccgaacccagaccccaggcccctgatctatatgatgatgacctggaatttcgccctccttctaggccacagtcgtctgataatcagcaatatttctgcgccccggcccctctgtcgcccagcgcccgacccaggtccccctggggcaagttagatccatacgactctagcgaggacgacaaggagtatgtagggttcgccacgctgcctaaccaggtgcatcggaagtcggtcaaaaagggcttcgattttactctgatggtggctggggaaagcggactgggcaaatccacactggtgaattctcttttcctgaccgacctgtacagagatcgcaagttgctgggtgcggaggagcggattatgcagaccgtcgagattacaaagcacgcagtggatatcgaggaaaagggggtccgcttgcgtctgactatcgttgacactcctgggttcggagatgcagtgaacaacacagaatgctggaagccggtggccgaatacattgaccagcaatttgagcagtatttcagggacgaatctggtctcaatcggaagaacatccaggataacagggtgcactgttgcctgtacttcatttcaccctttgggcacggcctacggcctttggatgtggagttcatgaaggcactgcatcagcgtgtgaatattgtcccaatcctagcgaaagcggacactttaaccccccccgaggtcgatcacaaaaagagaaaaatacgcgaagagattgagcacttcggaattaaaatatatcagtttccggactgcgactccgacgaggatgaggactttaagctccaggaccaagcactgaaagagtccataccgtttgccgtcatagggtctaacacagtagtggaagccagagggaggcgggtgcgcggccgcctgtacccatgggggatagtggaagtcgagaatccaggtcactgcgatttcgtcaaattacggaccatgttggtccggactcatatgcaagatctcaaggatgtaactcgtgaaacccattatgaaaactatcgcgctcagtgcatacagtccatgacccgcttggtggtcaaagagcgcaaccgcaataagctaaccagggagagtggcacagacttcccgatcccagccgtccctcctggaactgaccctgagacggagaagctaattagagagaaagatgaggagctgagacggatgcaggagatgctccacaaaattcagaaacaaatgaaggaaaactat

SEQ ID NO: 7475 - DNA, 1434 bp, Artificial Sequence
  Description of Artificial Sequence: Synthetic Transcript Sequence
atggatcggtcgctgggctggcagggcaatagcgtccctgaggaccgcaccgaggcaggaatcaagcggttcctggaggacaccactgatgatggagagctgagcaagttcgtgaaagacttctcaggcaacgcttcctgccatcccccagaagccaagacgtgggcgagcaggccgcaggtgccggagccacggccacaagctccggacctttacgatgacgacttggaattccggccgccgtcgcgcccacagtcctcggataatcagcaatacttctgcgcgccggcccctctctcccctagcgcaaggcctcgcagcccgtggggaaaactggacccctacgactcgtcggaggatgacaaggaatacgtgggatttgccactctcccgaatcaggtgcaccgcaagtcggtcaaaaagggtttcgattttactctcatggtcgcaggggaatccggactggggaagtcaacgttggtgaactctctgtttctcaccgatctgtaccgggatagaaagctgctgggagctgaggagagaataatgcagactgttgaaatcactaagcacgccgttgacatcgaagaaaagggagtccgtctccggctgaccatcgtggatactccaggatttggcgacgcggtcaacaacacggaatgctggaaaccagtggcggaatacatcgatcagcaattcgagcagtacttccgcgatgagtcaggactcaaccgaaaaaatatccaagacaaccgcgtgcactgctgcctgtacttcatctccccttttggtcatggcctgaggccactggacgtggaattcatgaaggccctgcatcagagggtgaatatcgtgccgatcctggccaaagccgataccctcaccccaccggaagtggaccataaaaagcgcaaaattcgcgaagaaatcgaacactttggaattaagatctaccaattccccgactgtgacagcgacgaggatgaggacttcaaactccaagaccaagcgctcaaggagtccattccattcgccgtgattggttccaacactgtcgtggaagctagaggacgccgggtccgcggcagactgtatccctgggggatcgtggaggtggaaaacccgggacattgcgacttcgtaaagctgcggaccatgcttgtgcgcacccacatgcaggacttgaaggatgtcaccagagagactcactatgaaaactacagagcacagtgtatccagtcgatgactaggctcgtcgtgaaggaaagaaatcggaacaaacttactcgcgaatcagggaccgatttccctatccctgccgtgccgccgggcaccgacccggaaaccgaaaagttgatccgagagaaggacgaagagctgcggcggatgcaagagatgcttcacaagatccagaagcagatgaaggaaaactac

SEQ ID NO: 7476 - DNA, 1434 bp, Artificial Sequence
  Description of Artificial Sequence: Synthetic Transcript Sequence
atggaccgttcgttgggatggcaaggcaatagcgtgcccgaagaccgcacggaggccgggatcaagaggttcctggaggacactactgacgacggcgaacttagcaagtttgtcaaggatttttcgggcaacgcttcctgccacccacctgaagccaagacctgggcatcgcgcccccaggtgcccgagccaaggcctcaggctcctgatttgtatgacgatgatctggagtttcgcccgccgtcccgccctcaatcctctgataaccagcagtacttctgcgctccggcccccctgtcgccctctgctcggccgcgttctccgtggggaaaactggacccttacgattccagcgaagatgataaggagtatgtaggttttgccacgctcccgaatcaggtccacaggaagagtgtgaagaaaggctttgatttcactctgatggttgctggcgaaagtggcctaggcaagtcgaccctggtgaacagcctgttcttaacagatctgtatcgagatcggaagctcctgggggcggaggagaggattatgcagaccgtcgaaattaccaagcacgcggtagatatcgaagagaaaggtgttagattgcgcctgacaatcgtcgacacccccgggttcggagacgctgtcaacaacaccgaatgttggaagccggtcgcagagtatatcgatcaacaatttgaacagtattttcgcgacgaaagcggattaaatcgcaagaacatacaagataatcgcgtgcactgctgtctttactttattagccctttcgggcatggactccggccgcttgatgtcgaattcatgaaagctctgcaccagcgggtgaacatcgtgccgatattggccaaggcggataccctgacgccgccagaagtggaccacaagaagcgaaagatcagagaagaaatcgaacacttcggcattaagatctaccaattccccgactgtgatagcgacgaggatgaagattttaagctgcaggatcaagcactgaaggagagtattcccttcgccgtgatcggatctaatactgtcgtggaagcgcgtggtcgtcgagtccggggacgcctctacccgtggggcatcgtggaggtggaaaacccgggtcactgcgattttgtgaaactccgcactatgctggtgagaacccatatgcaagacctcaaagatgtcacacgcgagacgcactacgagaactaccgcgcgcaatgtatccagtcgatgacacgactggtcgtgaaggagcgaaacaggaacaagctcacgcgcgagtcgggtaccgatttcccgatacccgcagttccgcctggaacggatccggaaactgaaaaactaatacgtgaaaaggacgaggaacttcgacgcatgcaggagatgcttcacaaaatccagaagcaaatgaaagagaactac

SEQ ID NO: 7477 - DNA, 1434 bp, Artificial Sequence
  Description of Artificial Sequence: Synthetic Transcript Sequence
atggatcgctcactgggatggcaaggcaattcggtgcccgaagatagaaccgaggcgggaatcaaaaggttcctggaagatactactgacgacggcgaactgtccaagttcgtcaaggatttttcgggaaacgcctcgtgccatccaccagaagcaaagacctgggcgtcgcggccccaggtcccggagccgcgcccgcaagctccagatttgtacgacgacgatcttgagttccggccaccgtcgcgtccgcaatcgtccgataatcaacagtatttctgcgcaccggccccactctccccctccgctcgcccacgctcaccgtggggaaagctggatccgtatgatagctcggaggacgataaggaatacgtcggatttgccaccctgcccaatcaggtccacaggaagtccgtcaagaagggcttcgacttcactctcatggtggctggcgagagcggactcggaaagtcgactctcgtgaattccctctttctcactgacctgtaccgcgatcggaagctgctgggagcggaagagagaatcatgcaaaccgtggagatcaccaagcatgcggtcgatatcgaagagaagggagtgcggctgcggcttactatagtggacaccccgggattcggggacgcagtgaataacaccgaatgctggaagccggtcgcggagtatattgaccaacagttcgaacagtacttccgcgacgaatccggacttaacaggaagaatattcaggataatagggtgcactgctgcctgtacttcatttcccctttcggtcacggcctgaggcccctggatgtcgagtttatgaaggccctgcatcaaagggtgaacatcgtccctattttggccaaggccgacactctgactccgcccgaagttgatcacaagaagcggaaaattcgggaagagatcgaacacttcggaatcaagatctaccaattcccggactgtgactccgatgaagatgaggacttcaagttgcaggatcaagccctcaaagaatccatcccgttcgcagtcatcgggtctaacacggtcgtcgaagctaggggacgacgcgtgcggggacgcctctacccgtggggaatcgtcgaggtggaaaatccaggacactgcgactttgttaagctgcgcaccatgctcgtccgcacgcacatgcaggacctgaaggacgtgacccgagagactcattacgagaactacagagcccaatgcatccagtcaatgactcgcctggtggtgaaggagcgcaacaggaacaagctgacccgggaatcgggtaccgactttccaatcccggcggtgccgccgggaacggacccggaaaccgaaaagctgatccgggagaaggacgaagagctccggagaatgcaggagatgctgcacaagatccagaagcagatgaaagaaaactac

SEQ ID NO: 7478 - DNA, 1434 bp, Artificial Sequence
  Description of Artificial Sequence: Synthetic Transcript Sequence
atggaccgctccctgggttggcaaggcaacagcgtgccagaggaccgcactgaggcgggtattaaacgcttcctggaagacacgacagacgacggtgaattgtccaagttcgtgaaggatttcagcggcaacgcttcttgccaccctccagaagcgaagacttgggccagccgccctcaagtgcctgagccacgtcctcaggctcctgacctgtatgatgatgacctagaattccgccccccgagccgcccccaaagcagcgacaaccaacagtacttctgcgctccagcaccactgagcccaagcgctcgcccgcggtccccatggggtaagttggacccatacgatagctcagaagatgacaaggaatatgtggggtttgcaaccctgcctaatcaagttcatcgtaaatctgtgaagaagggttttgattttactctcatggttgccggcgaatccggtctgggtaaatccaccttagtgaactcactgttcctaacggacctctaccgcgatcgcaaactgctgggtgcagaagaacgcatcatgcagacggtggaaattacgaaacacgccgtggacatcgaggagaagggtgttcgcctgcgattgactattgtggacactccgggattcggagatgcggttaataataccgagtgttggaaaccggtggcggaatatatcgaccaacaattcgaacaatactttagggatgagtctggcctaaatcgcaaaaatatccaagacaatcgcgtgcactgttgcctttactttatttcgccgtttggccacggcttaaggccactggacgttgagttcatgaaagccctgcaccagagagtcaacattgtaccgatcctggccaaggccgatacgctcactcctccggaagtggaccacaaaaagcgcaagattcgggaggaaattgagcacttcgggatcaaaatataccagttccctgattgtgacagcgatgaagacgaggactttaagctgcaggatcaagcactgaaggagagcattcctttcgcagtgattggcagcaacaccgtcgtcgaagcacgtgggcgtcgtgtcagaggcaggctgtatccgtggggtattgtggaggtcgagaacccaggtcactgcgacttcgttaaactgagaactatgctggtgcgcacacacatgcaagatctgaaggatgtgacccgtgagacgcattatgagaactacagagcacagtgtatccagtctatgactcgcctggtagtcaaagaacgcaacaggaacaagttgacccgcgagagcggtaccgatttcccaattccggcagttcctccgggtaccgatccggaaacggaaaagctgattcgtgagaaggatgaggagctacgccgaatgcaggaaatgctgcataagattcagaagcagatgaaggagaactac

SEQ ID NO: 7479 - DNA, 1434 bp, Artificial Sequence
  Description of Artificial Sequence: Synthetic Transcript Sequence
atggatcgatcccttggatggcaaggaaattccgtgccagaggataggactgaggctgggattaagcgatttctcgaagataccactgatgatggagaactctcgaagttcgtgaaggacttttccggaaatgcaagctgtcacccaccagaagcaaagacctgggcaagcaggccacaggtgccagaacctcgaccacaagcacctgacctttacgatgatgaccttgaatttagacccccgagccggcctcagtcatccgacaaccagcagtacttttgcgcacctgcacctctctccccttcagctagacctagatccccctggggcaagctcgacccatacgattcaagcgaagatgataaggaatacgtcggtttcgcaactctgccaaatcaggtgcacaggaagtcagtgaaaaaggggttcgatttcacgcttatggtggccggtgaaagcggactgggaaagtcgactcttgtcaactccctctttctgaccgatttgtacagagatcgaaaactccttggagcagaagagagaattatgcaaaccgtggagatcaccaagcacgcggtcgatatcgaggagaagggtgtgagactgcggctgactattgtggatacccctggctttggcgatgcagtgaataacaccgaatgttggaagccagtggccgagtacattgatcagcaattcgaacaatactttagagacgagtcgggccttaaccgcaaaaacatccaagacaatcgggtccattgctgtttgtactttatcagcccttttggacatggactccggcctctcgatgtggaattcatgaaggctcttcatcaacgcgtgaatattgtgccaatccttgccaaagccgataccctgactccccctgaggtggaccataagaaaagaaaaatccgggaggaaattgaacacttcggcattaagatatatcagttcccagactgtgactctgacgaagatgaggactttaagctgcaagatcaggcccttaaagaaagcataccttttgccgtgattggatcaaataccgtggtggaagcgagaggccggcgagtcagggggagactttacccgtggggaatcgtggaagtggagaaccctgggcattgtgattttgtgaagctcagaaccatgctggtgagaactcatatgcaggatctgaaagacgtgacgagggaaacccactacgagaattaccgcgcccaatgtatccaaagcatgactcgcttggttgtcaaggaacgcaatcgcaataagctgactcgggaatcaggtacggattttcctatccctgcagtgccccctggaactgatcctgaaaccgagaagctgattcgagagaaagatgaagagctccggaggatgcaggaaatgctgcataagatccaaaagcagatgaaggaaaactac

SEQ ID NO: 7480 - DNA, 1434 bp, Artificial Sequence
  Description of Artificial Sequence: Synthetic Transcript Sequence
atggatagatcgctgggctggcagggcaactctgtgccagaagatcgaacagaggcaggcatcaagcggttcctcgaagacactaccgatgacggcgagttgagcaagttcgtgaaagattttagtgggaatgcatcctgtcaccctcctgaagccaagacctgggcgagcaggcctcaagttcccgaacctcgaccacaggcccccgacctttacgatgacgacctcgagtttcgtcctccttcaagaccacagagttccgataatcagcagtacttttgtgctcctgcccctcttagccctagtgcaaggccgagaagtccttgggggaaactggatccatatgactcgtccgaggatgacaaggagtatgtaggtttcgcaactctccccaaccaggtgcacagaaagtccgtgaaaaagggctttgattttaccctcatggtcgccggggagagtggtctcgggaagtctaccctcgtgaactcgttgttcctgactgacctttatagggacaggaaattgctcggggccgaggaaaggatcatgcagaccgtggagattaccaagcatgctgtcgatatcgaggagaaaggtgtgagactgaggctgaccattgtggatactcctgggttcggagacgctgtgaacaacactgaatgctggaagcctgtagcggagtacatagatcagcagtttgaacagtactttcgagacgagtcagggctcaacagaaagaatatccaagacaatagggtgcattgttgcctatatttcatttctccttttggccacggcctgcggcccctggatgttgaattcatgaaggctctgcatcagcgagtaaatatcgttccaatcctggctaaagcggataccctcaccccccctgaggtggaccataagaaacggaaaatcagagaggagatcgagcattttggtatcaagatctaccagtttccggactgtgacagcgatgaggatgaggattttaagctccaggatcaagcattgaaggaaagtattccgttcgcagtgatcgggtcgaatacggtggttgaggctcgtggacgtagagtccgcggtcggctgtatccatggggtatcgttgaggtggagaacccaggacactgtgatttcgtcaagctgagaaccatgctcgttcgcacccacatgcaggatttgaaggatgtcacacgggagactcactacgagaattatcgcgcccagtgtattcagagcatgacccggctggtggtgaaagaaaggaaccggaacaaattgactagggaaagcggaaccgatttcccaatccctgctgttccacccggtaccgaccccgagaccgagaagcttatccgcgagaaggatgaagagctgagaagaatgcaggaaatgctgcataagatccagaagcagatgaaagagaattac

SEQ ID NO: 7481 - DNA, 1434 bp, Artificial Sequence
  Description of Artificial Sequence: Synthetic Transcript Sequence
atggaccggtcgctgggctggcagggtaattcggtaccggaagatagaactgaggccggcatcaagcggttcctggaggacactactgacgacggggaactgtccaagtttgtgaaggatttctccggaaacgccagctgccacccacctgaggctaaaacttgggcgtccagacctcaggtcccggaaccgcgcccacaagcgcccgacctctatgatgatgacttggaattcagaccgccatcgcgcccgcagtccagtgacaatcagcagtacttctgcgctccggcgccgctgtccccaagcgcacgccccaggagcccttgggggaaactggacccgtacgatagttcggaggatgacaaagaatatgtgggattcgcgacccttcctaaccaggtgcacaggaagtctgttaagaaggggtttgatttcactctcatggtggctggagaatcaggactgggtaagagcaccctcgtcaactccctcttcctgacggatttgtaccgcgaccgcaaattgctgggcgccgaggagcgcatcatgcaaacggtcgaaatcactaagcacgccgtggatatcgaagagaagggcgtgagactgaggctcacgattgtcgacaccccggggttcggtgacgccgttaacaatactgaatgctggaaaccagtggcggaatacatcgaccaacaattcgagcagtacttccgcgatgaatccggattgaatcggaagaatatccaggataatcgggtccattgctgtctgtacttcatctcaccattcggtcatggactccgacccctggatgttgagtttatgaaggcactccaccaacgggtgaacatcgtgccgatactggccaaagcagataccctgacgccgccagaagtggaccataagaaacgcaagatcagagaagaaatcgaacactttggaatcaagatttaccaatttcccgattgcgactcggacgaggacgaggacttcaagttgcaggaccaggcccttaaggaatcaatcccattcgctgtcatcggttcaaacactgtagtggaagctcgaggaaggcgcgtgcggggcagactgtacccgtggggtatcgtcgaggtggagaacccagggcattgcgacttcgtcaaattgaggaccatgcttgtcagaacgcacatgcaggatcttaaagacgtgaccagagaaacccattacgaaaactaccgcgcacagtgtatccaaagcatgacccggctcgtggtgaaggagcggaacaggaacaagttgactagagaatctggaaccgactttccaatccccgccgtgccgccaggcaccgatcctgagactgagaagctcattcgggagaaagacgaagagctgcggagaatgcaagaaatgctgcacaagatacagaagcagatgaaggaaaactac

SEQ ID NO: 7482 - DNA, 1434 bp, Artificial Sequence
  Description of Artificial Sequence: Synthetic Transcript Sequence
atggatcgatcactggggtggcaggggaattcggtacctgaagataggacggaagcgggcatcaagaggtttctggaagataccacagatgacggtgagctatcaaaattcgtgaaagatttttcaggtaacgcttcatgccatccgccagaggcaaagacgtgggccagcagaccccaggtcccagagccacggcctcaagcgccagacctgtatgacgacgatctcgaattcagacctccgagcaggccgcagtcctcagataatcagcaatacttctgtgccccggcaccgttgagcccatccgctaggcctcgctctccatggggtaaactggatccctacgatagtagcgaggatgacaaggaatatgtgggcttcgctacactccctaatcaggtgcatcgaaaatcggtcaaaaagggcttcgactttactctcatggtggccggtgagagtgggctcggcaagtctaccttggtgaactccctgttcctgacagatctgtacagggacagaaaactcctcggcgccgaggagcgaatcatgcaaactgtcgagattaccaagcacgctgtcgatatcgaagagaagggcgtgcggctgcggctgacaatcgtggacacccctggtttcggggatgcagtcaataacaccgagtgttggaagccagttgctgaatatatcgatcagcagtttgagcagtacttccgcgacgagtccggactgaatagaaagaacatccaggataatagagtacattgttgtctgtacttcatatccccatttgggcatggcctgcgacctcttgacgtggagttcatgaaggccctgcaccaaagggtgaatatcgtgcccatccttgcaaaggctgacactttgacgccaccggaggtcgatcataagaagcggaaaattcgggaggaaatcgaacacttcggaatcaagatctaccaatttcccgactgcgactctgacgaggatgaagatttcaagctccaagatcaggccttgaaagagagtatcccttttgctgtcattggctctaacaccgtcgtcgaagctcgaggtcgacgcgtgcgcggaagattgtacccttggggaatcgtagaagtcgaaaaccccgggcattgtgattttgttaagttgcggacgatgttggtacggacccacatgcaagatctcaaggatgtgaccagagagacgcactatgagaactaccgagcccagtgcatccagagcatgactcgcttggttgtgaaagaaaggaatcgaaataaactgacaagggagagcggaactgatttccctatacctgccgtccctcccggaactgatcccgaaacggagaaactgatcagggaaaaagatgaggagttacgaaggatgcaggagatgcttcataagatccaaaaacagatgaaggaaaactat

SEQ ID NO: 7483 - DNA, 1434 bp, Artificial Sequence; identical to SEQ ID NO: 7474
  Description of Artificial Sequence: Synthetic Transcript Sequence

SEQ ID NO: 7484 - DNA, 1434 bp, Artificial Sequence
  Description of Artificial Sequence: Synthetic Transcript Sequence
atggaccgatcgctgggatggcagggaaatagcgtgccagaggataggaccgaagctggaatcaaacggtttcttgaagatactactgatgatggcgaactttccaagttcgtgaaggatttttccggaaacgcctcatgtcatcccccagaggcaaagacctgggcctcccgcccacaggtgcctgagcctcggccacaagctcctgatctgtacgatgatgacctcgaatttcggcctccatcacgcccccagtccagcgataatcagcaatacttttgtgcacctgcccctctgtctccaagtgcccgaccaaggtcgccctggggaaagttggacccttacgatagcagcgaggatgataaggaatacgtgggcttcgcaactttgcctaaccaagttcatagaaagtccgtgaagaagggttttgactttacccttatggttgcaggggagtcggggctggggaagtccacccttgtgaatagcttgttccttaccgacctctatcgggatcggaaactccttggtgcggaagaaagaattatgcaaacggtggaaattaccaagcatgccgtggacatcgaagaaaagggggtgagactccggttgactattgtcgatactcccggtttcggtgatgccgtgaacaacacggaatgctggaagcccgtggcagaatacattgaccaacaatttgaacagtactttagggatgaatcgggtcttaaccgcaaaaacatacaggacaaccgggtccattgttgcctgtactttatcagccctttcggacatggtctgcggccgctggacgtggagtttatgaaggccctccatcagcgagtgaatatagtccctattctcgcaaaggcagataccctgaccccacctgaagtggaccataagaagcgcaagattagggaagaaattgagcatttcggaatcaagatttaccagttcccagattgtgacagcgatgaagatgaggatttcaaactccaagatcaagcgcttaaagaatcgattccatttgccgtcattggctcaaataccgtggtggaagcacgggggagaagggtcaggggacggctgtatccttggggtattgtggaagtggagaaccctggccattgtgatttcgtgaaattgcgaacgatgcttgtgagaactcatatgcaggatctcaaggatgtcaccagggaaactcactacgaaaactacagggcccaatgtatacaatcgatgacgcgtcttgtggtgaaggagaggaacagaaacaagctgacccgagaatcgggaacggacttccctatacccgctgtccctcctgggaccgaccccgagactgagaagctgattcgtgaaaaagacgaggaactgcggcgtatgcaggaaatgttgcacaagatacagaaacaaatgaaggagaactac

SEQ ID NO: 7485 - DNA, 1434 bp, Artificial Sequence
  Description of Artificial Sequence: Synthetic Transcript Sequence
atggatcgtagcctgggatggcaggggaacagtgtacccgaggacagaactgaagcaggaatcaagcggtttctggaagacacaacggatgatggggagctgagcaaattcgttaaggatttcagtggtaacgcctcttgtcacccccccgaagctaaaacttgggctagccgaccacaggtgccagaaccacggccccaggcacccgacctttacgatgatgatctagaatttagacccccctctcggccccagagctcagataaccagcagtacttttgcgcccccgctcctctgtctccatctgcccgtcctcggtctccctggggaaagctcgatccgtacgactcgtctgaggatgataaagaatacgtaggctttgcaaccttgcccaatcaggtgcaccgtaagtcagttaaaaaaggcttcgattttaccctcatggtcgccggagagtcaggattaggaaagtcaacactggttaatagcctgttcctgaccgatctttatagggatagaaaactgttaggcgccgaagaacgaataatgcagactgttgaaattactaagcacgccgtggatattgaggaaaaaggcgtccggctgcgcctcaccatcgtggacactccggggtttggcgatgctgttaataacaccgaatgttggaaaccagtggcggagtacattgaccaacagttcgaacagtatttccgagacgaaagtggtctcaaccgaaaaaatattcaggataatcgggtgcattgctgcctgtatttcatcagcccgtttggccacggcctaaggcccctggacgtggagttcatgaaggctctgcaccagcgagtgaacattgtacccattcttgcaaaggctgacacccttactccacccgaggtcgatcataaaaaaaggaaaatcagagaggaaattgagcactttggtatcaagatttaccaattcccggactgcgactctgatgaagatgaggatttcaagctgcaggaccaagccctcaaagaatcaattccctttgctgtgatcggctcaaacactgtcgtggaggcaagaggcaggagagtgagggggcgcttgtacccatggggtatcgtcgaagttgagaaccccggccattgtgattttgtaaagctcagaactatgctagtgcgcactcacatgcaggatcttaaggacgtcacccgggagactcactacgagaattaccgcgcacagtgtattcagtcaatgactcggctggtggttaaggagcgcaacagaaataaactcacccgcgagtctggtactgacttccctatacctgctgttcccccagggaccgatccagagaccgaaaagctaattcgagagaaggacgaggagctgaggagaatgcaggagatgctccataagattcagaagcagatgaaggagaattat

SEQ ID NO: 7486 - DNA, 1434 bp, Artificial Sequence
  Description of Artificial Sequence: Synthetic Transcript Sequence
atggacaggagcctgggatggcaaggtaattccgtgcctgaggataggaccgaggcaggaattaagcggttcttggaagataccaccgatgacggcgaattgtcgaagttcgtcaaggactttagtggtaatgcatcatgtcatcctccagaagcgaaaacttgggcatcaaggccacaggtgcctgagccacgcccgcaagccccagatctctatgatgatgatttggaattcagaccaccctcaagaccacaatcgtcggacaaccagcaatacttttgcgcgcctgcacccctttccccctccgccaggccacgcagcccttggggcaagctggacccgtatgattcatcggaggatgataaggaatacgtgggatttgcaacccttcctaaccaggtgcatcggaagagcgtgaagaaggggttcgactttacgctgatggtggcaggtgagagcggactcggcaaatcaaccctggtcaactcactttttctcactgatctgtatagggacagaaaacttcttggagcagaggaaagaatcatgcaaaccgttgagatcactaagcacgcagtggatatcgaagagaaaggagtgcgacttagacttaccattgtcgatacccccggattcggtgatgcggtcaataacactgaatgctggaagccagtagcagagtacatcgatcagcagttcgaacaatactttcgagatgaatctggtcttaaccgcaagaatatccaagataaccgcgtgcattgttgtctctacttcattagtccctttggacacggattgcgcccacttgatgtggaattcatgaaggccctccaccagagagtcaatatcgtgccaattctggcaaaggcggatacccttacccctcccgaagtggatcataagaagcgtaagattcgcgaggagattgaacactttggtatcaagatttaccaatttcctgactgtgatagcgacgaggatgaggactttaaacttcaagatcaagcccttaaagaatccataccattcgcagtcatcgggtccaacactgtcgtggaagcacgcggtcggagggtgagagggcgactgtacccctggggcattgtggaagtggaaaaccccggacactgcgactttgtgaaacttagaacgatgctggtgcgcactcatatgcaagatctgaaagatgtgactagagaaacccattacgagaattacagggcacaatgtatccaatcgatgactcgcctggttgtcaaggaacgaaacaggaataagctgacgagggaatctggcactgattttccgatcccagcagtccctcctggtaccgatccggaaactgagaagttgattcgggagaaggacgaagagctgcgaagaatgcaagaaatgctgcacaaaatccagaagcagatgaaggaaaactac

SEQ ID NO: 7487 - DNA, 1434 bp, Artificial Sequence
  Description of Artificial Sequence: Synthetic Transcript Sequence
atggatcgcagcctgggatggcaggggaatagcgttccagaggacaggaccgaagccggaattaaacggtttctggaggacactacagatgatggggagctgtccaagttcgtgaaagatttctctggtaatgccagttgccacccaccggaggctaagacatgggcttcacggccccaggtgcccgagcccaggccgcaggcacctgatctgtacgacgatgacctggaattccgtccaccgagtcgcccgcagtctagtgataatcagcagtatttttgtgctcccgcccccctgtcaccttccgccagacccagatccccctggggcaaactggacccatacgattcttccgaagacgataaagagtacgttgggttcgccactctgcctaatcaggtccaccggaagtctgtgaagaaaggttttgacttcacacttatggtagctggtgaatccggcctgggcaaaagcactttagtgaattcgctcttcctgaccgacctctacagagaccggaagctcctgggagcagaggagaggattatgcagaccgtggagatcaccaagcacgcagtggacattgaggaaaagggcgtgcgcctgagactaaccatagtggatactcccgggtttggcgatgccgtcaacaacactgagtgctggaaacccgttgcggagtatattgatcagcagtttgagcaatattttagggatgagtcaggactgaaccggaagaatattcaggataatcgggtgcattgttgcttgtacttcatctcacccttcggtcatggcctgagaccactcgatgtggagtttatgaaggcgctacaccagcgagtcaatatcgtgcctatactggcaaaggccgataccctgacacccccggaggtggatcataagaagagaaagatccgggaggaaatcgaacattttggaattaagatctaccagttcccggactgcgattctgacgaggacgaagattttaagctgcaggaccaggctctgaaggaaagtatccccttcgccgtgattgggtccaacaccgtggttgaggccaggggcaggcgcgtcagagggcggttgtatccgtggggaatagtggaggtagaaaatcccgggcattgcgacttcgtgaagcttcgtaccatgctggtgagaactcatatgcaggacctcaaggatgtgactcgagagacgcattacgaaaactacagggcgcagtgtattcagagcatgaccagactggtggtaaaagagcgaaacagaaacaagttgacccgagagagcggaacggactttcctatacccgccgtcccaccaggcaccgaccctgagaccgaaaaactaatacgagagaaagacgaggagctcaggcggatgcaagagatgttgcacaaaattcagaagcagatgaaagagaactat

SEQ ID NO: 7488 - DNA, 1434 bp, Artificial Sequence
  Description of Artificial Sequence: Synthetic Transcript Sequence
atggatagatcactcgggtggcagggaaactccgtgcccgaggatcgaactgaggccggcataaaacgatttcttgaggatacgaccgacgacggggaacttagcaaatttgtcaaagatttttccggaaatgcgtcctgtcaccccccagaggcaaaaacctgggcaagcagacctcaagtgccagaacccagaccgcaggcacctgacctgtacgatgacgatctggaatttcgcccgccttcgcgtccacaaagctcagacaaccagcaatacttttgtgcaccagcgcctctttcaccctccgctagacccagatcaccatggggaaagctggatccttacgatagctcggaagatgataaagagtacgttggatttgccaccctgccaaaccaggtgcacagaaagtctgtcaagaaaggttttgattttaccctgatggtggcaggagaaagcggtcttgggaaatcgacccttgtgaactcgctgtttctgactgatctgtacagagatcgaaagctgcttggagccgaagagcgcattatgcaaaccgtcgaaatcaccaagcatgcagtggatatcgaagagaagggtgtccgacttcgcctgacgattgtggatactcctgggtttggagatgcagtgaataacaccgaatgttggaagcctgtcgcagaatacattgaccaacagtttgaacaatacttccgtgacgaaagcggattgaaccgaaagaatatccaggacaatcgtgttcattgctgtctctactttatctcgccattcggacatggccttcgtccactcgatgtggagttcatgaaggcacttcatcaaagagtcaacatcgtccccattctggcaaaagcagataccctgactccacccgaagtggatcataagaagcggaagattcgggaggaaattgaacattttggaataaagatctaccagtttccagattgcgattcggatgaggacgaggatttcaaactgcaagatcaggctcttaaggaaagcattccatttgctgtgatcggctctaacacggtggttgaggcaagaggcagacgtgtgcgcggaaggctgtacccgtggggcattgtcgaagtcgaaaatcccgggcactgtgactttgtgaagctccgtaccatgctggtgcgcactcatatgcaagaccttaaggatgtgactcgagagactcactacgagaattaccgtgcacagtgcatccagtcgatgactagactcgtggtcaaagaacggaaccgaaacaagttgactagagagtcgggaaccgattttcccattccagcggtgccgcccgggactgaccctgaaacggaaaagctgattcgcgaaaaggatgaggaactgcgccgaatgcaagaaatgcttcataagattcaaaaacagatgaaggaaaactat

SEQ ID NO: 7489 - DNA, 1434 bp, Artificial Sequence
  Description of Artificial Sequence: Synthetic Transcript Sequence
atggataggtcgctcggctggcagggcaacagcgtgcccgaggaccgcactgaagctgggataaaacgctttctagaggataccactgacgacggtgagctgtccaaatttgtgaaagacttcagtgggaacgcctcatgtcaccccccagaagccaaaacgtgggctagccggccccaggtgccggaaccacgcccgcaagcgccggacctgtacgatgacgaccttgaattccggccaccctcccggccccagagtagtgacaaccagcagtatttttgcgcgccagccccattaagcccatctgccaggcccagaagcccttggggcaaactggatccctacgattcttccgaagacgataaggaatacgtgggcttcgcgaccctgccaaatcaggtgcatcggaagtccgtgaagaaaggcttcgacttcacactgatggtagcaggcgaaagcgggctgggaaaatccacgctggtgaattctctgtttctgactgatctgtaccgcgatcgcaaacttctgggcgcagaagagaggattatgcaaaccgtcgaaatcacaaagcacgcggttgacattgaggaaaagggtgttcgccttcgcctcactatcgtagatactcctggatttggggacgctgtcaacaatactgagtgttggaagcccgtggccgagtatatcgatcaacagttcgaacagtactttcgcgatgagtccggactcaaccgcaaaaacatacaagacaatcgcgtccactgttgtctgtattttatttctccttttggacatggcttacgtcctctggacgtggagttcatgaaagcattacaccaaagggtgaatatagttcccatcctggccaaagcagatacactgaccccccccgaggtcgaccacaaaaagaggaagatccgggaggaaatagagcatttcggcattaaaatctatcagtttcccgattgtgatagcgatgaggatgaggacttcaaactccaggatcaggcactaaaggagtccatcccttttgccgtcataggttctaacactgtggtcgaggcacgggggcggagagtcagaggtcgcttgtacccgtgggggattgtggaggtagaaaatccggggcattgtgattttgtcaaactacgtacaatgttagtccggactcatatgcaggacttgaaagacgtgacaagagaaacccactacgagaattaccgggcccagtgtatccagagcatgacgcggcttgttgtaaaagagagaaacagaaacaagctgacccgggagagcggtaccgattttccgattccggcagttcctccgggaaccgacccagaaacagaaaagctcatcagagagaaagacgaagagcttcggcgcatgcaggagatgttgcataaaattcaaaagcagatgaaagagaattat

SEQ ID NO: 7490 - protein, 261 aa, Unknown; identical to SEQ ID NO: 1367
  Description of Unknown: AIF-short protein

SEQ ID NO: 7491 - RNA, 736 nt, Artificial Sequence
  Description of Artificial Sequence: Synthetic Transcript Sequence
gggaaauaagagagaaaagaagaguaagaagaaauauaagagccaccauggcggcgggcgagcuugaggguggcaaaccccugagcgggcugcugaaugcgcuggcccaggacacuuuccacggguaccccggcaucacagaggagcugcuacggagccagcuauauccagaggugccacccgaggaguuccgccccuuucuggcaaagaugagggggauucuuaagucuauugcgucugcagacauggauuucaaccagcuggaggcauucuugacugcucaaaccaaaaagcaaggugggaucacaucugaccaagcugcugucauuuccaaauucuggaagagccacaagacaaaaauccgugagagccucaugaaccagagccgcuggaauagcgggcuucggggccugagcuggagaguugauggcaagucucagucaaggcacucagcucaaauacacacaccuguugccauuauagagcuggaauuaggcaaauauggacaggaaucugaauuucuguguuuggaauuugaugaggucaaagucaaccaaauucugaagacgcugucagagguagaagaaaguaucagcacacugaucagccagccuaacugauaauaggcuggagccucgguggccaugcuucuugccccuugggccuccccccagccccuccuccccuuccugcacccguacccccguggucuuugaauaaagucugagugggcggc

SEQ ID NO: 7492 - protein, 190 aa, Unknown; identical to SEQ ID NO: 2380
  Description of Unknown: COMMD1 protein

SEQ ID NO: 7493 - protein, 478 aa, Homo sapiens; identical to SEQ ID NO: 7356

SEQ ID NO: 7494 - RNA, 883 nt, Artificial Sequence
  Description of Artificial Sequence: Synthetic Transcript Sequence
gggaaauaagagagaaaagaagaguaagaagaaauauaagagccaccauggcggcucugaagaguuggcugucgcgcagcguaacuucauucuucagguacagacaguguuuguguguuccuguuguggcuaacuuuaagaagcgguguuucucagaauugauaagaccauggcacaaaacugugacgauuggcuuuggaguaacccugugugcgguuccuauugcacagaaaucagagccucauucccuuaguagugaagcauugaugaggagagcagugucuuugguaacagauagcaccucuaccuuucucucucagaccacauaugcguugauugaagcuauuacugaauauacuaaggcuguuuauaccuuaacuucucuuuaccgacaauauacaaguuuacuugggaaaaugaauucagaggaggaagaugaaguguggcaggugaucauaggagccagagcugagaugacuucaaaacaccaagaguacuugaagcuggaaaccacuuggaugacugcaguuggucuuucagagauggcagcagaagcugcauaucaaacuggcgcagaucaggccucuauaaccgccaggaaucacauucagcuggugaaacugcagguggaagaggugcaccagcucucccggaaagcagaaaccaagcuggcagaagcacagauagaagagcuccgucagaaaacacaggaggaaggggaggagcgggcugagucggagcaggaggccuaccugcgugaggauugauaauaggcuggagccucgguggccaugcuucuugccccuugggccuccccccagccccuccuccccuuccugcacccguacccccguggucuuugaauaaagucugagugggcggc

SEQ ID NO: 7495 - protein, 13 aa, Unknown
  Description of Unknown: AIFM1 peptide
DGEQHEDLNEVAK

SEQ ID NO: 7496 - protein, 14 aa, Unknown
  Description of Unknown: AIFM1 peptide
TGGLEIDSDFGGFR

SEQ ID NO: 7497 - protein, 8 aa, Unknown
  Description of Unknown: COMMD1 peptide
ESLMNQSR

SEQ ID NO: 7498 - protein, 18 aa, Unknown
  Description of Unknown: COMMD1 peptide
HSAQIHTPVAIIELELGK

SEQ ID NO: 7499 - protein, 6 aa, Unknown
  Description of Unknown: COMMD1 peptide
WNSGLR

SEQ ID NO: 7500 - protein, 21 aa, Unknown
  Description of Unknown: SEPT4 peptide
ESGTDFPIPAVPPGTDPETEK

SEQ ID NO: 7501 - protein, 13 aa, Unknown
  Description of Unknown: SEPT4 peptide
FLEDTTDDGELSK

SEQ ID NO: 7502 - protein, 8 aa, Unknown
  Description of Unknown: SEPT4 peptide
HAVDIEEK

SEQ ID NO: 7503 - protein, 10 aa, Unknown
  Description of Unknown: DIABLO peptide
AVYTLTSLYR

SEQ ID NO: 7504 - protein, 10 aa, Unknown
  Description of Unknown: DIABLO peptide
LAEAQIEELR

SEQ ID NO: 7505 - protein, 7 aa, Unknown
  Description of Unknown: DIABLO peptide
NHIQLVK

SEQ ID NO: 7506 - RNA, 1066 nt, Artificial Sequence
  Description of Artificial Sequence: Synthetic Transcript Sequence
gggaaauaagagagaaaagaagaguaagaagaaauauaagagccaccaugguagaaauagaugcagccuccguuuacacgcugccugcuggagcugacuuccucauguguuacucuguugcagaaggauauuauucucaccgggaaacugugaacggcucaugguacauucaagauuugugugagauguugggaaaauauggcuccuccuuagaguucacagaacuccucacacuggugaacaggaaaguuucucagcgccgaguggacuuuugcaaagacccaagugcaauuggaaagaagcagguucccuguuuugccucaaugcuaacuaaaaagcugcauuucuuuccaaaaucuaaucucgagcaccaccaccaccaccacguugaaauugaugggggaucccccaugagcucggccucggggcuccgcagggggcacccggcagguggggaagaaaacaugacagaaacagaugccuucuauaaaagagaaauguuugauccggcagaaaaguacaaaauggaccacaggaggagaggaauugcuuuaaucuucaaucaugagagguucuuuuggcacuuaacacugccagaaaggcggggcaccugcgcagauagagacaaucuuacccgcagguuuucagaucuaggauuugaagugaaaugcuuuaaugaucuuaaagcagaagaacuacugcucaaaauucaugaggugucaacuguuagccacgcagaugccgauugcuuugugugugucuuccugagccauggcgaaggcaaucacauuuaugcauaugaugcuaaaaucgaaauucagacauuaacuggcuuguucaaaggagacaagugucacagccugguuggaaaacccaagauauuuaucauccaggcaugucggggaaaccagcacgaugugccagucauuccuuuggauguaguagauugauaauaggcuggagccucgguggccaugcuucuugccccuugggccuccccccagccccuccuccccuuccugcacccguacccccguggucuuugaauaaagucugagugggcggc

SEQ ID NO: 7507 - RNA, 863 nt, Artificial Sequence
  Description of Artificial Sequence: Synthetic Transcript Sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 7508 - RNA, 1796 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 7509 - RNA, 1549 nt, Artificial Sequence
  Description of Artificial Sequence: Synthetic Transcript Sequence
gggaaauaagagagaaaagaagaguaagaagaaauauaagagccaccugacagcugaucaacuaaauuuaggcugaaucgccgggacucaucacaauaagccucuaggguuaucucuugucgguagauaauaccguguucuuguaacacgaaaacgcgauaaaaauaauuaaucgcccgaaguaauauaacuccggguaaauugaggaguuugugcagguaaaucuugaacgaguaagcugagaggagaauaacuccuuugaggaggcgagggaaguaguugauaaauaggagcgaacaacggaguuuuggaagcaauagguagugagggaccagugugagucgaauccgugccucuaagggggauuagguaaaguaaacaucaauagcuuaaauaacuggugcccguaaggguuugaagggaagaacugugagcugguagugacgugcaacaucuaaaacggacgcugugagcaguuaaguaaguaaacggcugacaauaaguagguuaacucgugcacaguaagauuaaggcuuaaggagaacugaaaaucgugcgagcccgcaguugaguuagcuuguggguaggugagcgugucacagacuagcaaguugacgagagcgugaacuguauuccccgacguggauagcgucaacagcauaaaagccuaaacaauccucgauaacaucacgcuaagcacucaguccuaauaaaacuuuacgagggucguagguggugaggacgcgaaacccggucaguuccccugacaggugguauugaacggugaagucguaaccuuuuaaggagguuccauugucaacguagaguguagugucacagcgugacacugcguagaaacaggagugaaaauuaagguaguggcguaggagcauaacauugaagagauaaagcacuaggaacaaaagcgaauaaucaucaguaacauuugacaccauaacuauaacgcggcaauagauaaguacuaacacgacaucgcacuuuugguaauugacuaacuauauaaacuuaauuuaaacgucaccccuauuuguauugccgugaaauaguuaaauaacaucuucuugaaauucggcuaaggguacguaucgggcuguaacagaguguucuuagaggguagauaagcacugguguugcaauaccucaggguguaacucgugguaagugacacuugucugcgguccaccaaauagacuagcuuagacaauuaauucugugcgggauuugauuaaggugggagagauagcugccugagagacucagggggucccugagugacggauaacgaggggacgucauuucugacgggaauuuagucuaagggagaggauauaacguagaaggggaaauuaggcaucuacacuaaagugucacgguuaaucaauuaaaucaaggaaaagacugaacucacgugauaauaggcuggagccucgguggccaugcuucuugccccuugggccuccccccagccccuccuccccuuccugcacccguacccccguggucuuugaauaaagucugagugggcggc

SEQ ID NO: 7510 - RNA, 1483 nt, Artificial Sequence
  Description of Artificial Sequence: Synthetic Transcript Sequence
gggaaauaagagagaaaagaagaguaagaagaaauauaagagccaccaugccccucaacguuagcuucaccaacaggaacuaugaccucgacuacgacucggugcagccguauuucuacugcgacgaggaggagaacuucuaccagcagcagcagcagagcgagcugcagcccccggcgcccagcgaggauaucuggaagaaauucgagcugcugcccaccccgccccuguccccuagccgccgcuccgggcucugcucgcccuccuacguugcggucacacccuucucccuucggggagacaacgacggcgguggcgggagcuucuccacggccgaccagcuggagauggugaccgagcugcugggaggagacauggugaaccagaguuucaucugcgacccggacgacgagaccuucaucaaaaacaucaucauccaggacuguauguggagcggcuucucggccgccgccaagcucgucucagagaagcuggccuccuaccaggcugcgcgcaaagacagcggcagcccgaaccccgcccgcggccacagcgucugcuccaccuccagcuuguaccugcaggaucugagcgccgccgccucagagugcaucgaccccucgguggucuuccccuacccucucaacgacagcagcucgcccaaguccugcgccucgcaagacuccagcgccuucucuccguccucggauucucugcucuccucgacggaguccuccccgcagggcagccccgagccccuggugcuccaugaggagacaccgcccaccaccagcagcgacucugaggaggaacaagaagaugaggaagaaaucgauguuguuucuguggaaaagaggcaggcuccuggcaaaaggucagagucuggaucaccuucugcuggaggccacagcaaaccuccucacagcccacugguccucaagaggugccacgucuccacacaucagcacaacuacgcagcgccucccuccacucggaaggacuauccugcugccaagagggucaaguuggacagugucagaguccugagacagaucagcaacaaccgaaaaugcaccagccccagguccucggacaccgaggagaaugucaagaggcgaacacacaacgucuuggagcgccagaggaggaacgagcuaaaacggagcuuuuuugcccugcgugaccagaucccggaguuggaaaacaaugaaaaggcccccaagguaguuauccuuaaaaaagccacagcauacauccuguccguccaagcagaggagcaaaagcucauuucugaagaggacuuguugcggaaacgacgagaacaguugaaacacaaacuugaacagcuacggaacucuugugcgugauaauaggcuggagccucgguggccaugcuucuugccccuugggccuccccccagccccuccuccccuuccugcacccguacccccguggucuuugaauaaagucugagugggcggc

SEQ ID NO: 7511 - RNA, 439 nt, Artificial Sequence
  Description of Artificial Sequence: Synthetic Transcript Sequence
gggaaauaagagagaaaagaagaguaagaagaaauauaagagccaccaugaccgaagaaaacgucaagagaagaacccauaauguccucgagcgccagcggcgcaaugagcucaagcgcagcuucuuugcacucagggaccaaauuccagaguuggagaacaacgaaaaggccccgaagguggugauccuuaagaaggcgacugccuacauccugucggugcaggcugagacucaaaagcugaucuccgaaaucgaucugcuccggaaacagaacgaacaacugaaacacaaacuggaacagcugcggaauucaugcgcgugauaauaggcuggagccucgguggccaugcuucuugccccuugggccuccccccagccccuccuccccuuccugcacccguacccccguggucuuugaauaaagucugagugggcggc

SEQ ID NO: 7512 - protein, 91 aa, Unknown
  Description of Unknown: MYC inhibitor A protein
MTEENVKRRTHNVLERQRRNELKRSFFALRDQIPELENNEKAPKVVILKKATAYILSVQAETQKLISEIDLLRKQNEQLKHKLEQLRNSCA

SEQ ID NO: 7513 - RNA, 439 nt, Artificial Sequence
  Description of Artificial Sequence: Synthetic Transcript Sequence
gggaaauaagagagaaaagaagaguaagaagaaauauaagagccaccaugaccgaagaaaacgucaagagaagaacccauaauguccucgagcgccagcggcgcaaugagcucaagcgcagcuucuuugcacucagggaccaaauuccagaguuggagaacaacgaaaaggccccgaagguggugauccuuaagaaggcgacugccuacauccugucggugcaggcugagaaucaaaagcugaucuccgaaaucgaucugcuccggaaacagaacgaacaacugaaacacaaacuggaacagcugcggaauucaugcgcgugauaauaggcuggagccucgguggccaugcuucuugccccuugggccuccccccagccccuccuccccuuccugcacccguacccccguggucuuugaauaaagucugagugggcggc

SEQ ID NO: 7514 - protein, 91 aa, Unknown
  Description of Unknown: MYC inhibitor B protein
MTEENVKRRTHNVLERQRRNELKRSFFALRDQIPELENNEKAPKVVILKKATAYILSVQAENQKLISEIDLLRKQNEQLKHKLEQLRNSCA

SEQ ID NO: 7515 - RNA, 439 nt, Artificial Sequence
  Description of Artificial Sequence: Synthetic Transcript Sequence
gggaaauaagagagaaaagaagaguaagaagaaauauaagagccaccaugagcgccgcugauaagcgggcucaccacaaugcguuggagaggaagaggcgcgaccacaucaaagacucguuccauucacuccgggacuccgugccgucgcugcaaggagaaaaagccucccgggcacagauccucgacaaggcgacugaguacauucaguacaugcgccgcaagaaccacacccaucagcaagauaucgacgaucuuaagagacagaacgcgcugcuggaacaacagguccgcgcacuggaaaaggccagaagcucagccugauaauaggcuggagccucgguggccaugcuucuugccccuugggccuccccccagccccuccuccccuuccugcacccguacccccguggucuuugaauaaagucugagugggcggc

SEQ ID NO: 7516 - protein, 91 aa, Unknown
  Description of Unknown: MYC inhibitor C protein
MSAADKRAHHNALERKRRDHIKDSFHSLRDSVPSLQGEKASRAQILDKATEYIQYMRRKNHTHQQDIDDLKRQNALLEQQVRALEKARSSA

SEQ ID NO: 7517 - protein, 90 aa, Unknown; identical to SEQ ID NO: 2483
  Description of Unknown: MYC inhibitor D protein

SEQ ID NO: 7518 - RNA, 1799 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaauaggcugccuucugcggggcuugccuucuggccaugcccuucuucucucccuugcaccuguaccucuuggucuuugaauaaagccugaguaggaag

SEQ ID NO: 7519 - RNA, 1821 nt, Artificial Sequence
  Description of Artificial Sequence: Synthetic Transcript Sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaauaggcugccuucugcggggcuugccuucuggccaugcccuucuucucucccuugcaccuguaccucucaaacaccauugucacacuccauggucuuugaauaaagccugaguaggaag

SEQ ID NO: 7520 - RNA, 783 nt, Artificial Sequence; identical to SEQ ID NO: 7325
  Description of Artificial Sequence: Synthetic Transcript Sequence

SEQ ID NO: 7521 - RNA, 776 nt, Artificial Sequence; identical to SEQ ID NO: 7327
  Description of Artificial Sequence: Synthetic Transcript Sequence

SEQ ID NO: 7522 - RNA, 758 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuggucuuugaauaaagccugaguaggaag

SEQ ID NO: 7523 - RNA, 780 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuccauaaaguaggaacacuacauggucuuugaauaaagccugaguaggaag

SEQ ID NO: 7524 - RNA, 765 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuacacuacuggucuuugaauaaagccugaguaggaag

SEQ ID NO: 7525 - RNA, 773 nt, Artificial Sequence
  Description of Artificial Sequence: Synthetic Transcript Sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugauaagcugccuucugcggggcuugccuucuggccaugcccuucuucucucccuugcaccuguaccucuuccauaaaguaggaauggucuuugaauaaagccugaguaggaag
